United States Patent
Subramanian et al.

(10) Patent No.: US 12,239,716 B2
(45) Date of Patent: *Mar. 4, 2025

(54) MUSCLE TARGETING COMPLEXES AND USES THEREOF FOR TREATING DYSTROPHINOPATHIES

(71) Applicant: Dyne Therapeutics, Inc., Waltham, MA (US)

(72) Inventors: Romesh R. Subramanian, Framingham, MA (US); Mohammed T. Qatanani, Waltham, MA (US); Timothy Weeden, Waltham, MA (US); Cody A. Desjardins, Waltham, MA (US); Brendan Quinn, Waltham, MA (US); John Najim, Waltham, MA (US)

(73) Assignee: Dyne Therapeutics, Inc., Waltham, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/805,883

(22) Filed: Aug. 15, 2024

(65) Prior Publication Data

US 2024/0408227 A1    Dec. 12, 2024

Related U.S. Application Data

(63) Continuation of application No. 18/609,032, filed on Mar. 19, 2024, now Pat. No. 12,102,687, which is a continuation of application No. 18/495,086, filed on Oct. 26, 2023, now Pat. No. 11,969,475, which is a continuation-in-part of application No. 18/490,905, filed on Oct. 20, 2023, now abandoned, which is a continuation of application No. 18/181,795, filed on Mar. 10, 2023, now Pat. No. 11,839,660, which is a continuation of application No. 17/811,401, filed on Jul. 8, 2022, now Pat. No. 11,672,872, said application No. 18/495,086 is a continuation-in-part of application No. 18/349,631, filed on Jul. 10, 2023, now Pat. No. 11,986,537, which is a continuation of application No. 17/811,370, filed on Jul. 8, 2022, now Pat. No. 11,771,776, said application No. 18/495,086 is a continuation-in-part of application No. 18/329,781, filed on Jun. 6, 2023, now Pat. No. 11,844,843, which is a continuation of application No. 18/063,795, filed on Dec. 9, 2022, now Pat. No. 11,679,161, which is a continuation of application No. 17/811,380, filed on Jul. 8, 2022, now Pat. No. 11,638,761, said application No. 18/495,086 is a continuation-in-part of application No. 18/181,700,
(Continued)

(51) Int. Cl.
| | |
|---|---|
| C07K 16/00 | (2006.01) |
| A61K 47/68 | (2017.01) |
| C07K 14/47 | (2006.01) |
| C07K 16/28 | (2006.01) |
| C12N 15/113 | (2010.01) |
| A61K 38/00 | (2006.01) |
| A61K 39/00 | (2006.01) |

(52) U.S. Cl.
CPC ...... *A61K 47/6807* (2017.08); *A61K 47/6849* (2017.08); *C07K 14/4707* (2013.01); *C07K 16/2881* (2013.01); *C12N 15/113* (2013.01); *A61K 38/00* (2013.01); *A61K 2039/505* (2013.01); *C07K 2317/24* (2013.01); *C07K 2317/33* (2013.01); *C07K 2317/55* (2013.01); *C07K 2317/77* (2013.01); *C07K 2317/92* (2013.01); *C07K 2317/94* (2013.01); *C12N 2310/11* (2013.01); *C12N 2310/14* (2013.01); *C12N 2310/3513* (2013.01)

(58) Field of Classification Search
None
See application file for complete search history.

(56) References Cited

U.S. PATENT DOCUMENTS

| | | |
|---|---|---|
| 2,631,173 A | 3/1953 | Hillyer et al. |
| 6,214,345 B1 | 4/2001 | Firestone et al. |

(Continued)

FOREIGN PATENT DOCUMENTS

| | | |
|---|---|---|
| CN | 102459597 A | 11/2010 |
| CN | 103443125 A | 12/2013 |

(Continued)

OTHER PUBLICATIONS

[No Author Listed] GenBank: AF095738.1. Mus musculus dystrophin gene, exons 22-25 and partial CDs. 2016. Retrieved from the internet Oct. 30, 2019: https://www.ncbi.nlm.nih.gov/nucleotide/AF095738.1?report=genbank&log$=nuclalign&blast_rank=3&RID=VKBMZ9WW014, 5 pages.

(Continued)

*Primary Examiner* — Meera Natarajan
(74) *Attorney, Agent, or Firm* — Wolf, Greenfield & Sacks, P.C.

(57) ABSTRACT

Aspects of the disclosure relate to complexes comprising a muscle-targeting agent covalently linked to a molecular payload. In some embodiments, the muscle-targeting agent specifically binds to an internalizing cell surface receptor on muscle cells. In some embodiments, the molecular payload promotes the expression or activity of a functional dystrophin protein. In some embodiments, the molecular payload is an oligonucleotide, such as an antisense oligonucleotide, e.g., an oligonucleotide that causes exon skipping in a mRNA expressed from a mutant DMD allele.

30 Claims, 33 Drawing Sheets
Specification includes a Sequence Listing.

Related U.S. Application Data filed on Mar. 10, 2023, now abandoned, which is a continuation of application No. 17/811,424, filed on Jul. 8, 2022, now Pat. No. 11,633,498.

(60) Provisional application No. 63/220,043, filed on Jul. 9, 2021, provisional application No. 63/220,262, filed on Jul. 9, 2021, provisional application No. 63/220,155, filed on Jul. 9, 2021, provisional application No. 63/220,144, filed on Jul. 9, 2021.

(56) References Cited

U.S. PATENT DOCUMENTS

| | | |
|---|---|---|
| 7,064,142 B2 | 6/2006 | Sato et al. |
| 7,265,131 B2 | 9/2007 | Johnson et al. |
| 7,534,879 B2 | 5/2009 | van Deutekom et al. |
| 7,575,886 B2 | 8/2009 | Venkataraman et al. |
| 7,902,160 B2 | 3/2011 | Matsuo et al. |
| 7,960,541 B2 | 6/2011 | Wilton et al. |
| 7,973,015 B2 | 7/2011 | van Ommen et al. |
| 8,084,601 B2 | 12/2011 | Graham et al. |
| 8,232,384 B2 * | 7/2012 | Wilton .............. C12N 15/113 536/24.31 |
| 8,324,371 B2 | 12/2012 | Popplewell et al. |
| 8,361,979 B2 | 1/2013 | van Ommen et al. |
| 8,455,636 B2 | 6/2013 | Fletcher et al. |
| 8,486,907 B2 | 7/2013 | Wilton et al. |
| 8,524,880 B2 | 9/2013 | Mcclorey et al. |
| 8,637,483 B2 | 1/2014 | Wilton et al. |
| 8,759,507 B2 | 6/2014 | van Deutekom et al. |
| 8,802,437 B2 | 8/2014 | Tremblay et al. |
| 8,859,629 B2 | 10/2014 | van Delft et al. |
| 8,865,883 B2 | 10/2014 | Kole et al. |
| 8,952,147 B2 | 2/2015 | Bouchard et al. |
| 9,018,368 B2 | 4/2015 | Wilton et al. |
| 9,024,007 B2 | 5/2015 | Wilton et al. |
| 9,035,040 B2 | 5/2015 | Wilton et al. |
| 9,078,911 B2 | 7/2015 | Lu et al. |
| 9,079,934 B2 | 7/2015 | Takeda et al. |
| 9,217,148 B2 | 12/2015 | Bestwick et al. |
| 9,222,940 B2 | 12/2015 | van Delft et al. |
| 9,228,187 B2 | 1/2016 | Meloni et al. |
| 9,243,245 B2 | 1/2016 | De Kimpe et al. |
| 9,260,371 B2 | 2/2016 | Bertozzi et al. |
| 9,416,361 B2 | 8/2016 | Iversen et al. |
| 9,422,555 B2 | 8/2016 | Wilton et al. |
| 9,447,415 B2 | 9/2016 | Wilton et al. |
| 9,447,416 B2 | 9/2016 | Sazani et al. |
| 9,504,758 B2 | 11/2016 | van Delft et al. |
| 9,506,058 B2 | 11/2016 | Kaye |
| 9,512,424 B2 | 12/2016 | Watanabe et al. |
| 9,528,109 B2 | 12/2016 | De Kimpe et al. |
| 9,550,834 B2 | 1/2017 | Shirai et al. |
| 9,610,362 B2 | 4/2017 | Armstrong |
| 9,611,323 B2 | 4/2017 | Dennis et al. |
| 9,650,632 B2 | 5/2017 | Popplewell et al. |
| 9,657,049 B2 | 5/2017 | Koizumi et al. |
| 9,657,050 B2 | 5/2017 | Koizumi et al. |
| 9,708,361 B2 | 7/2017 | Takeda et al. |
| 9,708,406 B2 | 7/2017 | Zhang et al. |
| 9,758,783 B2 | 9/2017 | Meloni et al. |
| 9,840,706 B2 | 12/2017 | Watanabe et al. |
| 9,890,381 B2 | 2/2018 | Watanabe et al. |
| 9,926,557 B2 | 3/2018 | De Kimpe et al. |
| 9,970,010 B2 | 5/2018 | Graham et al. |
| 9,988,629 B2 | 6/2018 | Takeda et al. |
| 9,994,851 B2 | 6/2018 | Wilton et al. |
| 10,100,304 B2 | 10/2018 | van Deutkom et al. |
| 10,131,682 B2 | 11/2018 | Zhao |
| 10,144,931 B2 | 12/2018 | Enya et al. |
| 10,190,116 B2 | 1/2019 | van Deutekom et al. |
| 10,227,590 B2 | 3/2019 | Wilton et al. |
| 10,238,753 B2 | 3/2019 | Armstrong |
| 10,239,807 B2 | 3/2019 | van Delft et al. |
| 10,266,502 B2 | 4/2019 | van Delft et al. |
| 10,266,827 B2 | 4/2019 | Wilton et al. |
| 10,287,586 B2 | 5/2019 | Wilson et al. |
| 10,329,319 B2 | 6/2019 | Watanabe et al. |
| 10,337,003 B2 | 7/2019 | Kaye |
| 10,364,431 B2 | 7/2019 | Kaye |
| 10,385,092 B2 | 8/2019 | Watanabe et al. |
| 10,407,461 B2 | 9/2019 | Watanabe et al. |
| 10,421,966 B2 | 9/2019 | Wilton et al. |
| 10,434,111 B2 | 10/2019 | Bertozzi et al. |
| 10,450,568 B2 | 10/2019 | Butler et al. |
| 10,457,944 B2 | 10/2019 | Popplewell et al. |
| RE47,691 E | 11/2019 | Wilton et al. |
| 10,487,106 B2 | 11/2019 | Watanabe et al. |
| RE47,751 E | 12/2019 | Wilton et al. |
| 10,533,171 B2 | 1/2020 | van Deutekom et al. |
| 10,533,174 B2 | 1/2020 | Iversen et al. |
| 10,550,188 B2 | 2/2020 | Geall et al. |
| 10,662,217 B2 | 5/2020 | Watanabe et al. |
| 10,704,060 B2 | 7/2020 | Gersbach et al. |
| 10,752,898 B2 | 8/2020 | Pietri et al. |
| 10,781,448 B2 | 9/2020 | Watanabe et al. |
| 10,781,450 B2 | 9/2020 | Wilton et al. |
| 10,781,451 B2 | 9/2020 | Wilton et al. |
| 10,876,114 B2 | 12/2020 | van Deutekom et al. |
| 10,913,946 B2 | 2/2021 | De Visser et al. |
| 10,968,450 B2 | 4/2021 | Wilton et al. |
| 10,994,020 B2 | 5/2021 | Levin et al. |
| 10,995,337 B2 | 5/2021 | Wilton et al. |
| 11,028,122 B1 | 6/2021 | Watanabe et al. |
| 11,111,309 B2 | 9/2021 | Subramanian et al. |
| 11,168,141 B2 | 11/2021 | Subramanian et al. |
| 11,179,472 B2 | 11/2021 | Levin et al. |
| 11,208,458 B2 | 12/2021 | Baik et al. |
| 11,230,605 B2 * | 1/2022 | Launay ................ A61P 37/06 |
| 11,248,056 B1 | 2/2022 | Subramanian et al. |
| RE48,960 E | 3/2022 | Wilton et al. |
| 11,286,305 B2 | 3/2022 | Subramanian et al. |
| 11,311,627 B1 | 4/2022 | Levin et al. |
| 11,369,689 B2 | 6/2022 | Subramanian et al. |
| 11,390,682 B2 | 7/2022 | Subramanian et al. |
| 11,400,163 B2 | 8/2022 | Levin et al. |
| 11,497,815 B2 | 11/2022 | Subramanian et al. |
| 11,518,816 B2 | 12/2022 | Subramanian et al. |
| 11,633,496 B2 | 4/2023 | Subramanian et al. |
| 11,633,498 B2 | 4/2023 | Subramanian et al. |
| 11,638,761 B2 | 5/2023 | Subramanian et al. |
| 11,648,318 B2 | 5/2023 | Subramanian et al. |
| 11,672,872 B2 | 6/2023 | Subramanian et al. |
| 11,679,161 B2 | 6/2023 | Subramanian et al. |
| 11,759,525 B1 | 9/2023 | Subramanian et al. |
| 11,771,776 B2 | 10/2023 | Subramanian et al. |
| 11,787,869 B2 | 10/2023 | Subramanian et al. |
| 11,795,233 B2 | 10/2023 | Subramanian et al. |
| 11,795,234 B2 | 10/2023 | Subramanian et al. |
| 11,833,217 B2 | 12/2023 | Subramanian et al. |
| 11,839,660 B2 | 12/2023 | Subramanian et al. |
| 11,844,843 B2 | 12/2023 | Subramanian et al. |
| 11,911,484 B2 | 2/2024 | Subramanian et al. |
| 11,931,421 B2 | 3/2024 | Hilderbrand et al. |
| 11,969,475 B2 | 4/2024 | Subramanian et al. |
| 11,986,537 B2 | 5/2024 | Subramanian et al. |
| 12,005,124 B2 | 6/2024 | Subramanian et al. |
| 12,012,460 B2 | 6/2024 | Subramanian et al. |
| 12,018,087 B2 | 6/2024 | Subramanian et al. |
| 12,064,483 B2 | 8/2024 | Levin et al. |
| 12,097,263 B2 | 9/2024 | Subramanian et al. |
| 12,102,687 B2 | 10/2024 | Subramanian et al. |
| 12,128,109 B2 | 10/2024 | Weeden et al. |
| 2004/0063654 A1 | 4/2004 | Davis et al. |
| 2004/0191243 A1 | 9/2004 | Chen et al. |
| 2005/0084906 A1 | 4/2005 | Goetsch et al. |
| 2005/0282252 A1 | 12/2005 | Siegel |
| 2006/0110782 A1 | 5/2006 | Bertozzi et al. |
| 2006/0252107 A1 | 11/2006 | Kubota et al. |
| 2007/0050146 A1 | 3/2007 | Bentwich et al. |
| 2008/0025913 A1 | 1/2008 | Bowdish et al. |
| 2008/0177045 A1 | 7/2008 | Lee et al. |
| 2009/0269755 A1 | 10/2009 | Aartsma-Rus et al. |
| 2010/0130591 A1 | 5/2010 | Sazani et al. |

(56) References Cited

U.S. PATENT DOCUMENTS

| | | |
|---|---|---|
| 2010/0168212 A1 | 7/2010 | Popplewell et al. |
| 2011/0256157 A1 | 10/2011 | Howard et al. |
| 2011/0263682 A1 | 10/2011 | De Kimpe et al. |
| 2012/0059042 A1 | 3/2012 | Platenburg et al. |
| 2012/0077860 A1 | 3/2012 | Garcia et al. |
| 2012/0122801 A1 | 5/2012 | Platenburg |
| 2012/0201809 A1 | 8/2012 | Bhat et al. |
| 2012/0270925 A1 | 10/2012 | Wilton et al. |
| 2013/0028891 A1 | 1/2013 | Penichet et al. |
| 2013/0041017 A1 | 2/2013 | Kaplan et al. |
| 2013/0066063 A1 | 3/2013 | Berry et al. |
| 2013/0072541 A1 | 3/2013 | Garcia et al. |
| 2013/0137763 A1 | 5/2013 | van Delft et al. |
| 2013/0177579 A1 | 7/2013 | Lin et al. |
| 2014/0105916 A1 | 4/2014 | Brasel et al. |
| 2014/0193436 A1 | 7/2014 | Prudent |
| 2014/0323552 A1 | 10/2014 | Burghes et al. |
| 2014/0363455 A1 | 12/2014 | Stull et al. |
| 2015/0064181 A1 | 3/2015 | Armstrong |
| 2015/0191725 A1 | 7/2015 | van Deutekom et al. |
| 2015/0196670 A1 | 7/2015 | Dickson et al. |
| 2015/0247141 A1 | 9/2015 | Uhlmann et al. |
| 2015/0258210 A1 | 9/2015 | van Delft et al. |
| 2015/0266954 A1 | 9/2015 | Davies et al. |
| 2016/0015828 A1 | 1/2016 | Torgov et al. |
| 2016/0053262 A1 | 2/2016 | Platenburg et al. |
| 2016/0107999 A1 | 4/2016 | Debets et al. |
| 2016/0175460 A1 | 6/2016 | Arathoon et al. |
| 2016/0235861 A1 | 8/2016 | van Delft et al. |
| 2016/0237157 A1 | 8/2016 | Dennis et al. |
| 2016/0250347 A1 | 9/2016 | van Delft et al. |
| 2016/0272973 A1 | 9/2016 | Shehadeh |
| 2016/0304864 A1 | 10/2016 | De Kimpe et al. |
| 2016/0355599 A1 | 12/2016 | Sagert et al. |
| 2017/0002012 A1 | 1/2017 | van Delft et al. |
| 2017/0008858 A1 | 1/2017 | van Delft et al. |
| 2017/0072068 A1 | 3/2017 | Verkade et al. |
| 2017/0130256 A1 | 5/2017 | van Berkel et al. |
| 2017/0226554 A1 | 8/2017 | Wasiel et al. |
| 2017/0281795 A1 | 10/2017 | Geall et al. |
| 2017/0283799 A1 | 10/2017 | Kaye et al. |
| 2017/0348416 A1 | 12/2017 | Hasler et al. |
| 2018/0002433 A1 | 1/2018 | Zhang et al. |
| 2018/0028554 A1 | 2/2018 | De Visser et al. |
| 2018/0134797 A1 | 5/2018 | Zhang et al. |
| 2018/0142245 A1 | 5/2018 | Watanabe et al. |
| 2018/0171333 A1 | 6/2018 | Meloni et al. |
| 2018/0179538 A1 | 6/2018 | Takeda et al. |
| 2018/0265859 A1 | 9/2018 | Tremblay et al. |
| 2018/0369400 A1 | 12/2018 | Levin et al. |
| 2019/0000986 A1 | 1/2019 | Levin et al. |
| 2019/0008986 A1 | 1/2019 | Butler et al. |
| 2019/0038765 A1 | 2/2019 | van Berkel et al. |
| 2019/0092833 A1 | 3/2019 | Lin et al. |
| 2019/0092870 A1 | 3/2019 | Launay et al. |
| 2019/0112604 A1 | 4/2019 | De Kimpe et al. |
| 2019/0119383 A1 | 4/2019 | Bruenker et al. |
| 2019/0119679 A1 | 4/2019 | De Kimpe et al. |
| 2019/0127733 A1 | 5/2019 | Butler et al. |
| 2019/0153083 A1 | 5/2019 | Juste et al. |
| 2019/0177723 A1 | 6/2019 | Dickson et al. |
| 2019/0177725 A1 | 6/2019 | De Kimpe et al. |
| 2019/0209604 A1 | 7/2019 | Zhang et al. |
| 2019/0240346 A1 | 8/2019 | Sugo et al. |
| 2019/0249173 A1 | 8/2019 | Vargeese et al. |
| 2019/0270994 A1 | 9/2019 | Wilton et al. |
| 2019/0284556 A1 | 9/2019 | Sazani et al. |
| 2019/0298847 A1 | 10/2019 | Geall et al. |
| 2019/0323010 A1 | 10/2019 | Wilton et al. |
| 2019/0330626 A1 | 10/2019 | Rigo et al. |
| 2019/0336615 A1 | 11/2019 | Thompson et al. |
| 2019/0338311 A1 | 11/2019 | Amoasii et al. |
| 2019/0359982 A1 | 11/2019 | Kaye et al. |
| 2019/0364862 A1 | 12/2019 | Amoasii et al. |
| 2019/0390197 A1 | 12/2019 | Butler et al. |
| 2020/0040337 A1 | 2/2020 | Kaye et al. |
| 2020/0046742 A1 | 2/2020 | Bertozzi et al. |
| 2020/0046854 A1 | 2/2020 | Zhang et al. |
| 2020/0048174 A1 | 2/2020 | van Delft et al. |
| 2020/0123267 A1 | 4/2020 | Zhang et al. |
| 2020/0155702 A1 | 5/2020 | Bacica et al. |
| 2020/0239886 A1 | 7/2020 | De Kimpe et al. |
| 2020/0282074 A1 | 9/2020 | Levin et al. |
| 2020/0325237 A1 | 10/2020 | Darimont et al. |
| 2020/0385457 A1 | 12/2020 | McNally et al. |
| 2021/0038739 A1 | 2/2021 | Takahashi et al. |
| 2021/0130486 A1 | 5/2021 | Darimont et al. |
| 2021/0145852 A1 | 5/2021 | Passini et al. |
| 2021/0147576 A1 | 5/2021 | Laurent et al. |
| 2021/0187116 A1 | 6/2021 | Geall et al. |
| 2021/0206868 A1 | 7/2021 | Subramanian et al. |
| 2021/0220479 A1 | 7/2021 | Subramanian et al. |
| 2021/0228730 A1 | 7/2021 | Subramanian et al. |
| 2021/0230290 A1 | 7/2021 | Subramanian et al. |
| 2021/0261680 A1 | 8/2021 | Subramanian et al. |
| 2021/0308272 A1 | 10/2021 | Subramanian et al. |
| 2021/0308273 A1 | 10/2021 | Subramanian et al. |
| 2021/0308274 A1 | 10/2021 | Subramanian et al. |
| 2021/0317226 A1 | 10/2021 | Subramanian et al. |
| 2021/0322562 A1 | 10/2021 | Subramanian et al. |
| 2021/0322563 A1 | 10/2021 | Subramanian et al. |
| 2021/0324101 A1 | 10/2021 | Subramanian et al. |
| 2021/0380709 A1 | 12/2021 | Subramanian et al. |
| 2022/0025066 A1 | 1/2022 | Subramanian et al. |
| 2022/0143206 A1 | 5/2022 | Subramanian et al. |
| 2022/0169743 A1 | 6/2022 | Subramanian et al. |
| 2022/0193250 A1 | 6/2022 | Subramanian et al. |
| 2022/0288220 A1 | 9/2022 | Subramanian et al. |
| 2022/0306685 A1 | 9/2022 | Weeden et al. |
| 2022/0324992 A1 | 10/2022 | Subramanian et al. |
| 2022/0378934 A1 | 12/2022 | Subramanian et al. |
| 2023/0001002 A1 | 1/2023 | Subramanian et al. |
| 2023/0044278 A1 | 2/2023 | Subramanian et al. |
| 2023/0045002 A1 | 2/2023 | Subramanian et al. |
| 2023/0045314 A1 | 2/2023 | Subramanian et al. |
| 2023/0049450 A1 | 2/2023 | Subramanian et al. |
| 2023/0050911 A1 | 2/2023 | Subramanian et al. |
| 2023/0051954 A1 | 2/2023 | Subramanian et al. |
| 2023/0088865 A1 | 3/2023 | Subramanian et al. |
| 2023/0103793 A1 | 4/2023 | Subramanian et al. |
| 2023/0111147 A1 | 4/2023 | Subramanian et al. |
| 2023/0111212 A1 | 4/2023 | Subramanian et al. |
| 2023/0113823 A1 | 4/2023 | Subramanian et al. |
| 2023/0117883 A1 | 4/2023 | Subramanian et al. |
| 2023/0118799 A1 | 4/2023 | Subramanian et al. |
| 2023/0144436 A1 | 5/2023 | Subramanian et al. |
| 2023/0203180 A1 | 6/2023 | Subramanian et al. |
| 2023/0203181 A1 | 6/2023 | Subramanian et al. |
| 2023/0226212 A1 | 7/2023 | Subramanian et al. |
| 2023/0227569 A1 | 7/2023 | Subramanian et al. |
| 2023/0256112 A1 | 8/2023 | Subramanian et al. |
| 2023/0256113 A1 | 8/2023 | Subramanian et al. |
| 2023/0270873 A1 | 8/2023 | Subramanian et al. |
| 2023/0272065 A1 | 8/2023 | Subramanian et al. |
| 2023/0285582 A1 | 9/2023 | Subramanian et al. |
| 2023/0285586 A1 | 9/2023 | Subramanian et al. |
| 2023/0287108 A1 | 9/2023 | Subramanian et al. |
| 2023/0321264 A1 | 10/2023 | Subramanian et al. |
| 2023/0330247 A1 | 10/2023 | Hildebrand et al. |
| 2023/0330562 A1 | 10/2023 | Weeden et al. |
| 2023/0346966 A1 | 11/2023 | Subramanian et al. |
| 2023/0346967 A1 | 11/2023 | Subramanian et al. |
| 2024/0016950 A1 | 1/2024 | Weeden et al. |
| 2024/0016952 A1 | 1/2024 | Subramanian et al. |
| 2024/0066139 A1 | 2/2024 | Subramanian et al. |
| 2024/0066140 A1 | 2/2024 | Subramanian et al. |
| 2024/0067743 A1 | 2/2024 | Subramanian et al. |
| 2024/0067744 A1 | 2/2024 | Subramanian et al. |
| 2024/0100177 A1 | 3/2024 | Hildebrand et al. |
| 2024/0110184 A1 | 4/2024 | Brown et al. |
| 2024/0117356 A1 | 4/2024 | Subramanian et al. |
| 2024/0148891 A1 | 5/2024 | Subramanian et al. |
| 2024/0197901 A1 | 6/2024 | Subramanian et al. |
| 2024/0197905 A1 | 6/2024 | Subramanian et al. |

(56) References Cited

U.S. PATENT DOCUMENTS

| | | |
|---|---|---|
| 2024/0207430 A1 | 6/2024 | Subramanian et al. |
| 2024/0209119 A1 | 6/2024 | Subramanian et al. |
| 2024/0216522 A1 | 7/2024 | Subramanian et al. |
| 2024/0238435 A1 | 7/2024 | Subramanian et al. |
| 2024/0252666 A1 | 8/2024 | Hilderbrand et al. |
| 2024/0287201 A1 | 8/2024 | Subramanian et al. |
| 2024/0293568 A1 | 9/2024 | Subramanian et al. |
| 2024/0294921 A1 | 9/2024 | Subramanian et al. |
| 2024/0301416 A1 | 9/2024 | Tone et al. |
| 2024/0309107 A1 | 9/2024 | Subramanian et al. |
| 2024/0318176 A1 | 9/2024 | Desjardins et al. |
| 2024/0318177 A1 | 9/2024 | Desjardins et al. |
| 2024/0325558 A1 | 10/2024 | Zanotti et al. |

FOREIGN PATENT DOCUMENTS

| | | |
|---|---|---|
| CN | 103732259 A | 4/2014 |
| CN | 105142672 A | 12/2015 |
| CN | 108220418 | 6/2018 |
| CN | 109306375 A | 2/2019 |
| EP | 1479771 A2 | 11/2004 |
| EP | 1619249 A1 | 1/2006 |
| EP | 2203173 B1 | 7/2010 |
| EP | 2284264 A1 | 2/2011 |
| EP | 2426203 A2 | 3/2012 |
| EP | 2614827 A2 | 7/2013 |
| EP | 2801618 A1 | 11/2014 |
| EP | 2612917 B1 | 2/2016 |
| EP | 2623609 B1 | 1/2017 |
| EP | 3238737 A1 | 11/2017 |
| EP | 3315606 A1 | 5/2018 |
| EP | 2499249 B1 | 8/2018 |
| EP | 2922818 B1 | 9/2018 |
| EP | 3436588 A1 | 2/2019 |
| EP | 3473270 A1 | 4/2019 |
| EP | 3560958 A1 | 10/2019 |
| EP | 3565577 A1 | 11/2019 |
| EP | 3684376 A1 | 7/2020 |
| EP | 3691657 A1 | 8/2020 |
| EP | 3735252 A2 | 11/2020 |
| EP | 2806900 B1 | 2/2021 |
| EP | 3018211 B1 | 6/2021 |
| EP | 3898693 A1 | 10/2021 |
| EP | 3959319 A1 | 3/2022 |
| EP | 3980436 A1 | 4/2022 |
| EP | 3980437 A1 | 4/2022 |
| EP | 4126066 A1 | 2/2023 |
| EP | 4146229 A1 | 3/2023 |
| EP | 4314298 A1 | 2/2024 |
| IL | 54795 A | 10/1980 |
| JP | 2002-253259 A | 9/2002 |
| JP | 2015-534996 A | 12/2015 |
| WO | WO 1989/007970 A1 | 9/1989 |
| WO | WO 1991/004753 A1 | 4/1991 |
| WO | WO 2006/000057 A1 | 1/2006 |
| WO | WO 2006/022688 A1 | 3/2006 |
| WO | WO 2007/135105 A1 | 11/2007 |
| WO | WO 2009/054725 A2 | 4/2009 |
| WO | WO 2009/144481 A2 | 12/2009 |
| WO | WO 2010/048586 A1 | 4/2010 |
| WO | WO 2010/050801 A1 | 5/2010 |
| WO | WO 2010/050802 A1 | 5/2010 |
| WO | WO 2010/123369 A1 | 10/2010 |
| WO | WO 2010/129861 A1 | 11/2010 |
| WO | WO 2011/057350 A1 | 5/2011 |
| WO | WO 2011/078797 A2 | 6/2011 |
| WO | WO 2011/136645 A1 | 11/2011 |
| WO | WO 2011/150408 A2 | 12/2011 |
| WO | WO 2011/154427 A1 | 12/2011 |
| WO | WO 2012/029986 A1 | 3/2012 |
| WO | WO 2012/075037 A1 | 6/2012 |
| WO | WO 2012/087962 A2 | 6/2012 |
| WO | WO 2013/026832 A1 | 2/2013 |
| WO | WO 2013/085550 A2 | 6/2013 |
| WO | WO 2013/100190 A1 | 7/2013 |
| WO | WO 2013/112053 A1 | 8/2013 |
| WO | WO 2013/138662 A1 | 9/2013 |
| WO | WO 2013/162363 A1 | 10/2013 |
| WO | WO 2014/007620 A2 | 1/2014 |
| WO | WO 2014/065661 A1 | 5/2014 |
| WO | WO 2014/144978 A2 | 9/2014 |
| WO | WO 2014/153220 A2 | 9/2014 |
| WO | WO 2014/153240 A2 | 9/2014 |
| WO | WO 2015/042581 A1 | 3/2015 |
| WO | WO 2015/134365 A2 | 9/2015 |
| WO | WO 2015/179741 A1 | 11/2015 |
| WO | WO 2016/081643 A1 | 5/2016 |
| WO | WO 2016/081670 A2 | 5/2016 |
| WO | WO 2016/187425 A1 | 11/2016 |
| WO | WO 2016/205641 A2 | 12/2016 |
| WO | WO 2017/047707 A1 | 3/2017 |
| WO | WO 2017/062835 A2 | 4/2017 |
| WO | WO 2017/062862 A2 | 4/2017 |
| WO | WO 2017/100467 A2 | 6/2017 |
| WO | WO 2017/106643 A1 | 6/2017 |
| WO | WO 2017/143156 A1 | 8/2017 |
| WO | WO 2017/173408 A1 | 10/2017 |
| WO | WO 2017/192679 A1 | 11/2017 |
| WO | WO 2017/205191 A1 | 11/2017 |
| WO | WO 2017/205513 A1 | 11/2017 |
| WO | WO 2017/221883 A1 | 12/2017 |
| WO | WO 2018/007475 A1 | 1/2018 |
| WO | WO 2018/014042 A1 | 1/2018 |
| WO | WO 2018/017754 A1 | 1/2018 |
| WO | WO 2018/091544 A1 | 5/2018 |
| WO | WO 2018/098480 A1 | 5/2018 |
| WO | WO 2018/100010 A1 | 6/2018 |
| WO | WO 2018/107003 A1 | 6/2018 |
| WO | WO 2018/118627 A1 | 6/2018 |
| WO | WO 2018/129296 A1 | 7/2018 |
| WO | WO 2018/129384 A1 | 7/2018 |
| WO | WO 2018/226861 A1 | 12/2018 |
| WO | WO 2019/014772 A1 | 1/2019 |
| WO | WO 2019/059973 A1 | 3/2019 |
| WO | WO 2019/060775 A1 | 3/2019 |
| WO | WO 2019/067975 A1 | 4/2019 |
| WO | WO 2019/071028 A1 | 4/2019 |
| WO | WO 2019/079637 A2 | 4/2019 |
| WO | WO 2019/092507 A2 | 5/2019 |
| WO | WO 2019/113393 A1 | 6/2019 |
| WO | WO 2019/136180 A2 | 7/2019 |
| WO | WO 2019/136216 A1 | 7/2019 |
| WO | WO 2019/151539 A1 | 8/2019 |
| WO | WO 2019/152609 A1 | 8/2019 |
| WO | WO 2019/157224 A1 | 8/2019 |
| WO | WO 2019/200185 A1 | 10/2019 |
| WO | WO 2019/215175 A1 | 11/2019 |
| WO | WO 2019/215333 A1 | 11/2019 |
| WO | WO 2019/217784 A1 | 11/2019 |
| WO | WO 2019/209764 A2 | 12/2019 |
| WO | WO 2019/229658 A1 | 12/2019 |
| WO | WO 2019/241385 A2 | 12/2019 |
| WO | WO 2019/246480 A1 | 12/2019 |
| WO | WO 2020/028831 A1 | 2/2020 |
| WO | WO 2020/028832 A1 | 2/2020 |
| WO | WO 2020/028836 A1 | 2/2020 |
| WO | WO 2020/028840 A1 | 2/2020 |
| WO | WO 2020/028841 A1 | 2/2020 |
| WO | WO 2020/028842 A1 | 2/2020 |
| WO | WO 2020/028844 A1 | 2/2020 |
| WO | WO 2020/028857 A1 | 2/2020 |
| WO | WO 2020/028861 A1 | 2/2020 |
| WO | WO 2020/028864 A1 | 2/2020 |
| WO | WO 2020/084488 A1 | 4/2020 |
| WO | WO 2020/094670 A1 | 5/2020 |
| WO | WO 2020/118246 A1 | 6/2020 |
| WO | WO 2020/132584 A1 | 6/2020 |
| WO | WO 2020/198268 A1 | 10/2020 |
| WO | WO 2020/209285 A1 | 10/2020 |
| WO | WO 2020/214763 A1 | 10/2020 |
| WO | WO 2020/219820 A1 | 10/2020 |
| WO | WO 2020/247738 A1 | 12/2020 |
| WO | WO 2020/247782 A1 | 12/2020 |
| WO | WO 2020/247818 A1 | 12/2020 |

(56) References Cited

FOREIGN PATENT DOCUMENTS

| | | |
|---|---|---|
| WO | WO 2020/257489 A1 | 12/2020 |
| WO | WO 2021/003573 A1 | 1/2021 |
| WO | WO 2021/068761 A1 | 4/2021 |
| WO | WO 2021/076856 A1 | 4/2021 |
| WO | WO 2021/108640 A1 | 6/2021 |
| WO | WO 2021/142217 A1 | 7/2021 |
| WO | WO 2021/142227 A1 | 7/2021 |
| WO | WO 2021/142234 A1 | 7/2021 |
| WO | WO 2021/142260 A1 | 7/2021 |
| WO | WO 2021/142269 A1 | 7/2021 |
| WO | WO 2021/142275 A1 | 7/2021 |
| WO | WO 2021/142307 A1 | 7/2021 |
| WO | WO 2021/142313 A1 | 7/2021 |
| WO | WO 2021/142331 A1 | 7/2021 |
| WO | WO 2021/150382 A1 | 7/2021 |
| WO | WO 2021/154476 A1 | 8/2021 |
| WO | WO 2021/154477 A1 | 8/2021 |
| WO | WO 2022/020105 A1 | 1/2022 |
| WO | WO 2022/020106 A1 | 1/2022 |
| WO | WO 2022/020107 A1 | 1/2022 |
| WO | WO 2022/020108 A1 | 1/2022 |
| WO | WO 2022/020109 A1 | 1/2022 |
| WO | WO 2022/026152 A1 | 2/2022 |
| WO | WO 2022/051665 A1 | 3/2022 |
| WO | WO 2022/056266 A2 | 3/2022 |
| WO | WO 2022/120132 A1 | 6/2022 |
| WO | WO 2022/147207 A1 | 7/2022 |
| WO | WO 2022/147209 A1 | 7/2022 |
| WO | WO 2022/212886 A1 | 10/2022 |
| WO | WO 2022/213118 A1 | 10/2022 |
| WO | WO 2022/217366 A1 | 10/2022 |
| WO | WO 2022/232478 A1 | 11/2022 |
| WO | WO 2022/270585 A1 | 12/2022 |
| WO | WO 2022/271543 A2 | 12/2022 |
| WO | WO 2022/271549 A1 | 12/2022 |
| WO | WO 2023/283531 A2 | 1/2023 |
| WO | WO 2023/283613 A1 | 1/2023 |
| WO | WO 2023/283614 A2 | 1/2023 |
| WO | WO 2023/283615 A1 | 1/2023 |
| WO | WO 2023/283619 A2 | 1/2023 |
| WO | WO 2023/283620 A1 | 1/2023 |
| WO | WO 2023/283623 A1 | 1/2023 |
| WO | WO 2023/283624 A2 | 1/2023 |
| WO | WO 2023/283629 A1 | 1/2023 |
| WO | WO 2023/022229 A1 | 2/2023 |
| WO | WO 2023/026994 A1 | 3/2023 |
| WO | WO 2023/034818 A1 | 3/2023 |
| WO | WO 2023/044398 A1 | 3/2023 |
| WO | WO 2023/077120 A1 | 5/2023 |
| WO | WO 2023/086864 A1 | 5/2023 |
| WO | WO 2023/121444 A1 | 6/2023 |
| WO | WO 2023/121445 A1 | 6/2023 |
| WO | WO 2023/121446 A1 | 6/2023 |
| WO | WO 2023/141710 A1 | 8/2023 |
| WO | WO 2023/154807 A2 | 8/2023 |
| WO | WO 2023/168427 A1 | 9/2023 |
| WO | WO 2023/171820 A1 | 9/2023 |
| WO | WO 2023/178230 A1 | 9/2023 |
| WO | WO 2023/196400 A2 | 10/2023 |
| WO | WO 2023/201318 A1 | 10/2023 |
| WO | WO 2023/201324 A1 | 10/2023 |
| WO | WO 2023/201332 A1 | 10/2023 |
| WO | WO 2024/011135 A1 | 1/2024 |
| WO | WO 2024/011150 A1 | 1/2024 |
| WO | WO 2024/064237 A1 | 3/2024 |
| WO | WO 2024/097644 A1 | 5/2024 |
| WO | WO 2024/112809 A2 | 5/2024 |
| WO | WO 2024/149282 A1 | 7/2024 |
| WO | WO 2024/182358 A1 | 9/2024 |

OTHER PUBLICATIONS

[No Author Listed] GenBank: CAE7739414. Unnamed protein product, partial [Symbiodinium pilosum]. Feb. 18, 2021. Retrieved from the internet Oct. 12, 2022: https://www.ncbi.nlm.nih.gov/protein/CAE7739414.1.1?report=genbank&log$=prottop&blast_rank=1&RID=MDW2CW3T013, 1 page.

[No Author Listed] GenBank: NP_001121620. transferrin receptor protein 1 isoform 1 [Homo sapiens]. Dec. 28, 2017. Retrieved from the internet Aug. 2, 2023: https://www.ncbi.nlm.nih.gov/protein/NP_001121620.1, 4 pages.

[No Author Listed] GenBank: PKK91089. Hypothetical protein CVV64_04785 [Candidatus Wallbacteria bacterium HGW-Wallbacteria-1]. Oct. 13, 2017. Retrieved from the internet Oct. 12, 2022: https://www.ncbi.nlm.nih.gov/protein/PKK91089.1?report=genbank&log$=prottop&blast_rank=2&RID=MDW2CW3T013, 2 pages.

[No Author Listed] UniProtKB/Swiss-Prot P02786. Transferrin receptor protein 1. Jul. 18, 2018. Retrieved from the Internet Oct. 23, 2019: https://www.uniprot.org/uniprot/P02786.txt?version=225, 20 pages.

[No Author Listed] Wikipedia, Dystrophin, Mar. 9, 2018. Retrieved from the internet Nov. 5, 2019: https://en.wikipedia.org/w/index.php?title=Dystrophin&oldid=829543258, 10 pages.

[No Author Listed] Wikipedia, Mannose 6-phosphate receptor, Mar. 23, 2018. Retrieved from the internet Nov. 6, 2019: https://en.wikipedia.org/w/index.php?title=Mannose_6-phosphate_receptor&oldid=832003836, 8 pages.

[No Author Listed] Wikipedia, Myotonic dystrophy, Sep. 8, 2017. Retrieved from the internet Nov. 5, 2019: https://en.wikipedia.org/w/index.php?title=Myotonic_dystrophy&oldid=799605783, 9 pages.

[No Author Listed], Exondys (eteplirsen): EPAR—Refusal public assessment report and Annex: Scientific conclusions and grounds for refusal. European Medicines Agency. Sep. 20, 2018. 140 pages.

[No Author Listed], Building the world's leading muscle disease company. Dyne Company Overview. Jun. 2021. 42 pages.

[No Author Listed], Clinical trial summary NCT000159250 (drisapersen) (Version 2, dated Feb. 19, 2007). 14 pages.

[No Author Listed], Highlights of prescribing information EXONDYS 51. FDA. <accessdata.fda.gov> Sep. 2016. Retrieved May 22, 2021. 11 pages.

[No Author Listed], IRDye® Peptide Labeling Application Guide. <https://licor.com/documents/nmekjs7iez6sw5p8fv7b7005chbrcog7> Published Apr. 2013. Retrieved Oct. 27, 2021. 8 pages.

[No Author Listed], Morpholino History, Production, and Properties. Gene Tools. Retrieved from https://gene-tools.com/history_production_and_properties. Accessed Jan. 9, 2023. 9 pages.

[No Author Listed], NCBI "NM_004006.2(DMD)". Published Oct. 30, 2020. Accessed from ncbi.nlm.nih.gov on May 21, 2021. 2 pages.

[No Author Listed], Transferrin Receptor/CD71 Extracellular Domain (human, recombinant) 2021, retrieved from https://www.caymanchem.com/product/32031/transferrin-receptor-extracellular-domain-(human%2C-recombinant)#:-:text=Cayman's Transferrin Receptor%2FCD71 Extracellular,molecular weight of 103.6 kDa (Year: 2021). 3 pages.

Aartsma-Rus et al., Antisense-induced multiexon skipping for Duchenne muscular dystrophy makes more sense. Am J Hum Genet. Jan. 2004;74(1):83-92. Epub Dec. 16, 2003.

Aartsma-Rus et al., Antisense-mediated exon skipping: a versatile tool with therapeutic and research applications. RNA. Oct. 2007;13(10):1609-24. doi: 10.1261/rna.653607. Epub Aug. 7, 2007.

Aartsma-Rus et al., Guidelines for antisense oligonucleotide design and insight into splice-modulating mechanisms. Mol Ther. Mar. 2009;17(3):548-53. doi: 10.1038/mt.2008.205. Epub Sep. 23, 2008.

Aartsma-Rus et al., Less is more: therapeutic exon skipping for Duchenne muscular dystrophy. Lancet Neurol. Oct. 2009;8(10):873-5. doi: 10.1016/S1474-4422(09)70229-7. Epub Aug. 25, 2009.

Aartsma-Rus et al., Progress in therapeutic antisense applications for neuromuscular disorders. Eur J Hum Genet. Feb. 2010;18(2):146-53. Epub Oct. 7, 2009.

Aartsma-Rus et al., Targeted exon skipping as a potential gene correction therapy for Duchenne muscular dystrophy. Neuromuscul Disord. Oct. 2002;12 Suppl 1:S71-7. doi: 10.1016/s0960-8966(02)00086-x.

(56) References Cited

OTHER PUBLICATIONS

Aartsma-Rus, Antisense-mediated modulation of splicing: therapeutic implications for Duchenne muscular dystrophy. RNA Biol. Jul.-Aug. 2010;7(4):453-61. doi: 10.4161/rna.7.4.12264. Epub Jul. 1, 2010.
Adams et al., Antisense oligonucleotide induced exon skipping and the dystrophin gene transcript: cocktails and chemistries. BMC Mol Biol. Jul. 2, 2007;8:57.
Agard et al., A Comparative Study of Bioorthogonal Reactions with Azides. ACS Chem. Biol. 2006;1(10):644-8. Epub Oct. 20, 2006.
Agard et al., A Strain-Promoted [3+2] Azide-Alkyne Cycloaddition for Covalent Modification of Biomolecules in Living Systems. J. Am. Chem. Soc. Nov. 2004; 126(46):15046- 7.
Alter et al., Systemic delivery of morpholino oligonucleotide restores dystrophin expression bodywide and improves dystrophic pathology. Nat Med. Feb. 2006;12(2):175-7. doi: 10.1038/nm1345. Epub Jan. 29, 2006.
Altshuler et al., Generation of recombinant antibodies and means for increasing their affinity. Biochemistry (Mosc). Dec. 2010;75(13):1584-605.
Anciaux et al., Transition-metal-catalyzed reactions of diazo compounds. 1. Cyclopropanation of double bonds. The Journal of Organic Chemistry. Feb. 1980;45(4):695-702.
Antony-Mayer et al., Bicyclo[6.1.0]nonynes. Chemische Berichte. Nov. 1988;121(11):2013-8.
Aoki et al., Challenges for antisense oligonucleotide-based therapeutics, in particular for exon 51-skipping in Duchenne muscular dystrophy, 2011 Fourth International Conference on Modeling, Simulation and Applied Optimization, 2011, 1-6, doi: 10.1109/ICMSAO.2011.5775520.
Arechavala-Gomeza et al., Comparative analysis of antisense oligonucleotide sequences for targeted skipping of exon 51 during dystrophin pre-mRNA splicing in human muscle. Hum Gene Ther. Sep. 2007;18(9):798-810. doi: 10.1089/hum.2006.061.
Arnett et al., Therapy for neuromuscular disorders. Curr Opin Genet Dev. Jun. 2009;19(3):290-7. doi: 10.1016/j.gde.2009.03.005. Epub May 4, 2009.
Ast et al., Estergruppenhaltige Polyalkenylene durch Olefin-Metathese. Die Makromolekulare Chemie. May 1976;177(5):1349-55.
Barrientos et al., Metabolic Catastrophe in Mice Lacking Transferrin Receptor in Muscle. EBioMedicine. Oct. 4, 2015;2(11):1705-17. doi: 10.1016/j.ebiom.2015.09.041. eCollection Nov. 2015.
Baskin et al., Copper-free click chemistry for dynamic in vivo imaging. PNAS. Oct. 2007;104(43):16793-7.
Beskrovnaya, FORCE™ platform delivers exon skipping PMO, leads to durable increases in dystrophin protein in mdx mice and is well tolerated NHPs. Presented at Muscle Study Group Annual Scientific Meeting. Oct. 1, 2021. 29 pages.
Bien-Ly et al., Transferrin receptor (TfR) trafficking determines brain uptake of TfR antibody affinity variants. J Exp Med. Feb. 10, 2014;211(2):233-44. Epub Jan. 27, 2014.
Black, 9.13.4.1.1.3.2 Variation 2: C-Alkylation (and Arylation) by Carbenes and Free Radicals. Science of Synthesis. 2001;9:514.
Brown et al., Tolerance to single, but not multiple, amino acid replacements in antibody VH CDR 2: a means of minimizing B cell wastage from somatic hypermutation? J Immunol. May 1, 1996;156(9):3285-91.
Bushby et al., MSG/ENMC FOR DMD Trial Study Group. 145th ENMC International Workshop: planning for an International Trial of Steroid Dosage Regimes in DMD (FOR DMD), Oct. 22-24, 2006, Naarden, The Netherlands. Neuromuscul Disord. May 2007;17(5):423-8. doi: 10.1016/j.nmd.2007.01.006. Epub Apr. 11, 2007.
Bushby et al., Report on the 124th ENMC International Workshop. Treatment of Duchenne muscular dystrophy; defining the gold standards of management in the use of corticosteroids. Apr. 2-4, 2004, Naarden, The Netherlands. Neuromuscul Disord. Sep. 2004;14(8-9):526-34.
Bushby et al., The multidisciplinary management of Duchenne muscular dystrophy. Curr Paed. 2005; 15: 292-300.
Bushel et al., Blood gene expression signatures predict exposure levels. Proc Natl Acad Sci USA. Nov. 13, 2007;104(46):18211-6. doi: 10.1073/pnas.0706987104. Epub Nov. 2, 2007.
Campbell et al., Deflazacort for the treatment of Duchenne Dystrophy: a systematic review. BMC Neurol. Sep. 8, 2003;3:7. doi: 10.1186/1471-2377-3-7. Epub Sep. 8, 2003.
Candelaria et al., Antibodies Targeting the Transferrin Receptor 1 (TfR1) as Direct Anti-cancer Agents. Front Immunol. Mar. 17, 2021;12:607692.
Casi et al., Antibody-drug conjugates: basic concepts, examples and future perspectives. J Control Release. Jul. 20, 2012;161(2):422-8. doi: 10.1016/j.jconrel.2012.01.026. Epub Jan. 28, 2012.
Cenik et al., Argonaute proteins. Curr Biol. Jun. 21, 2011;21(12):R446-9.
Chen et al., In-depth structural characterization of Kadcyla® (ado-trastuzumab emtansine) and its biosimilar candidate. MAbs. Oct. 2016;8(7):1210-1223. doi: 10.1080/19420862.2016.1204502. Epub Jul. 5, 2016.
Chothia et al., Canonical structures for the hypervariable regions of immunoglobulins. J Mol Biol. Aug. 20, 1987;196(4):901-17. doi: 10.1016/0022-2836(87)90412-8.
Cirak et al., Exon skipping and dystrophin restoration in patients with Duchenne muscular dystrophy after systemic phosphorodiamidate morpholino oligomer treatment: an open-label, phase 2, dose-escalation study. Lancet. Aug. 13, 2011;378(9791):595-605. doi: 10.1016/S0140-6736(11)60756-3. Epub Jul. 23, 2011.
Clark et al., Increased brain uptake of targeted nanoparticles by adding an acid-cleavable linkage between transferrin and the nanoparticle core. PNAS. Oct. 2015;112(40):12486-91.
Codelli et al., Second-Generation Difluorinated Cyclooctynes for Copper-Free Click Chemistry. J. Am. Chem. Soc. 2008;130(34):11486-11493. Epub Aug. 5, 2008.
Coico et al., Immunology: A short course. 2008 (originally published 2003): 61-2. 8 pages (including English translation).
Crook et al., Enrichment of early fetal-liver hemopoietic stem cells of the rat using monoclonal antibodies against the transferrin receptor, Thy-1, and MRC-OX82. Dev Immunol. 1996;4(4):235-46. doi: 10.1155/1995/85036.
Crooke et al., The Effects of 2'-O-Methoxyethyl Oligonucleotides on Renal Function in Humans. Nucleic Acid Ther. Feb. 2018;28(1):10-22. doi: 10.1089/nat.2017.0693. Epub Nov. 29, 2017.
Cuellar et al., Systematic evaluation of antibody-mediated siRNA delivery using an industrial platform of THIOMAB-siRNA conjugates. Nucleic Acids Res. Jan. 2015;43(2):1189-203. Epub Dec. 30, 2014.
Curtius, Ueber die Einwirkung von salpetriger Säure auf salzsauren Glycocolläther. Berichte der deutschen chemischen Gesellschaft. Jul.-Dec. 1883;16(2):2230-1.
Danis et al., Potential therapeutic application of antisense oligonucleotides in the treatment of ocular diseases. Expert Opin Pharmacother. Feb. 2001;2(2):277-91.
Darimont et al., A novel antibody-oligonucleotide conjugate (AOC) platform enables efficient regulation of muscle targets in mice. Abstract. 8-05. J. Cach Sarcopen Musc. 2017; 8: 1065-66.
Debets et al., Bioorthogonal labelling of biomolecules: new functional handles and ligation methods. Org Biomol Chem. Oct. 14, 2013;11(38):6439-55. Epub Aug. 23, 2013.
Demonceau et al., Novel Ruthenium-Based Catalyst Systems for the Ring-Opening Metathesis Polymerization of Low-Strain Cyclic Olefins. Macromolecules. 1997;30(11):3127-36. Epub Jun. 2, 1997.
Desguerre et al . . . Endomysial fibrosis in Duchenne muscular dystrophy: a marker of poor outcome associated with macrophage alternative activation. J Neuropathol Exp Neurol. Jul. 2009;68(7):762-73.
Desjardins et al., Building a FORCE™ platform-based DMD franchise for the treatment of individuals with mutations amenable to exon skipping. Neuromusc Dis. Oct. 2022; 32: S101-2. Abstract.
Desjardins et al., Building a Force™ platform-based DMD franchise for the treatment of individuals with mutations amenable to exon skipping. Presented at 27th Int Hybrid Annual Congress of the World Muscle Society. Oct. 11-15, 2022. Poster. 1 page.
Desjardins et al., Enhanced exon skipping and prolonged dystrophin restoration achieved by TfR1-targeted delivery of antisense oligo-

(56) References Cited

OTHER PUBLICATIONS nucleotide using FORCE conjugation in mdx mice. Nucleic Acids Res. Nov. 11, 2022;50(20):11401-11414.
Desjardins et al., Enhanced exon skipping and prolonged dystrophin restoration achieved by TfR1-targeted delivery of antisense oligonucleotide using FORCE conjugation in mdx mice. Nucleic Acids Res. Nov. 11, 2022;50(20):11401-11414. Supplemental Figures and Figure Legends. 34 pages.
Desjardins et al., Force™ platform achieves robust exon skipping, restores dystrophin at the sarcolemma and halts progression of fibrosis in the severe D2-mdx model of DMD. Abstract. Mar. 2023. 1 page.
Desjardins et al., Force™ platform achieves robust exon skipping, restores dystrophin at the sarcolemma and halts progression of fibrosis in the severe D2-mdx model of DMD. Poster. Presented at the Muscular Dystrophy Association Clinical and Scientific Conference. Mar. 19-22, 2023. 1 page.
Dommerholt et al., Readily accessible bicyclononynes for bioorthogonal labeling and three-dimensional imaging of living cells. Angew Chem Int Ed. Dec. 3, 2010;49(49):9422-5.
Dommerholt et al., Strain-Promoted 1,3-Dipolar Cycloaddition of Cycloalkynes and Organic Azides. Top Curr Chem. Apr. 2016;374(2):16. doi: 10.1007/s41061-016-0016-4. Epub Mar. 22, 2016.
Echigoya et al., Effects of systemic multiexon skipping with peptide-conjugated morpholinos in the heart of a dog model of Duchenne muscular dystrophy. Proc Natl Acad Sci U S A. Apr. 18, 2017;114(16):4213-4218. doi: 10.1073/pnas.1613203114. Epub Apr. 3, 2017.
Echigoya et al., Exons 45-55 Skipping Using Mutation-Tailored Cocktails of Antisense Morpholinos in the DMD Gene. Mol Ther. Nov. 6, 2019;27(11):2005-2017. doi: 10.1016/j.ymthe.2019.07.012. Epub Jul. 26, 2019.
Echigoya et al., Quantitative Antisense Screening and Optimization for Exon 51 Skipping in Duchenne Muscular Dystrophy. Mol Ther. Nov. 1, 2017;25(11):2561-2572. doi: 10.1016/j.ymthe.2017.07.014. Epub Jul. 28, 2017.
Efferth et al., Enhancement of cytotoxicity of artemisinins toward cancer cells by ferrous iron. Free Radic Biol Med. Oct. 1, 2004;37(7):998-1009. doi: 10.1016/j.freeradbiomed.2004.06.023.
Egli et al., Re-Engineering RNA Molecules into Therapeutic Agents. Acc Chem Res. Apr. 16, 2019;52(4):1036-1047. doi: 10.1021/acs.accounts.8b00650. Epub Mar. 26, 2019.
Elangkovan et al., Gene Therapy for Duchenne Muscular Dystrophy. J Neuromuscul Dis. 2021;8(s2):S303-S316.
Fletcher et al., Morpholino oligomer-mediated exon skipping averts the onset of dystrophic pathology in the mdx mouse. Mol Ther. Sep. 2007;15(9):1587-92. doi: 10.1038/sj.mt.6300245. Epub Jun. 19, 2007.
Frazier, Antisense oligonucleotide therapies: the promise and the challenges from a toxicologic pathologist's perspective. Toxicol Pathol. Jan. 2015;43(1):78-89. doi: 10.1177/0192623314551840. Epub Nov. 9, 2014.
Freed et al., Pharmacology Review(s) for Application No. 206488Orig1s000. Center for Drug Evaluation and Research (CDER). Published May 25, 2016. Accessed from accessdata.fda.gov on May 21, 2021. 97 pages.
Geary et al., Pharmacokinetics, biodistribution and cell uptake of antisense oligonucleotides. Adv Drug Deliv Rev. Jun. 29, 2015;87:46-51. doi: 10.1016/j.addr.2015.01.008. Epub Feb. 7, 2015.
Gebski et al., Morpholino antisense oligonucleotide induced dystrophin exon 23 skipping in mdx mouse muscle. Hum Mol Genet. Aug. 1, 2003;12(15):1801-11.
Girones et al. Comparison of the kinetics of cycling of the transferrin receptor in the presence or absence of bound diferric transferrin. Biochem J. Nov. 15, 1989;264(1):35-46.
Goemans et al., Systemic administration of PRO051 in Duchenne's muscular dystrophy. N Engl J Med. Apr. 21, 2011;364(16):1513-22. doi: 10.1056/NEJMoa1011367. Epub Mar. 23, 2011. Erratum in: N Engl J Med. Oct. 6, 2011;365(14):1361.
Gong et al., Simple Method to Prepare Oligonucleotide-Conjugated Antibodies and Its Application in Multiplex Protein Detection in Single Cells. Bioconjug Chem. Jan. 20, 2016;27(1):217-25. doi: 10.1021/acs.bioconjchem.5b00613. Epub Jan. 4, 2016.
Gray et al., Combinatorial peptide libraries: mining for cell-binding peptides. Chem Rev. Jan. 22, 2014;114(2):1020-81.
Griggs et al., Prednisone in Duchenne dystrophy. A randomized, controlled trial defining the time course and dose response. Clinical Investigation of Duchenne Dystrophy Group. Arch Neurol. Apr. 1991;48(4):383-8. doi: 10.1001/archneur.1991.00530160047012.
Guirguis et al., Disease-drug interaction: Reduced response to propranolol despite increased concentration in the rat with inflammation. J Pharm Sci. May 2003;92(5):1077-84. Abstract.
Haack et al., Toxic rise of clozapine plasma concentrations in relation to inflammation. Eur Neuropsychopharmacol. Oct. 2003;13(5):381-5.
Hein et al., Click chemistry, a powerful tool for pharmaceutical sciences. Pharm Res. Oct. 2008;25(10):2216-30. doi: 10.1007/s11095-008-9616-1. Epub May 29, 2008.
Helguera et al. An antibody recognizing the apical domain of human transferrin receptor 1 efficiently inhibits the entry of all new world hemorrhagic Fever arenaviruses. J Virol. Apr. 2012;86(7):4024-8. doi: 10.1128/JVI.06397-11. Epub Jan. 25, 2012.
Henry et al., Chemically modified oligonucleotides exhibit decreased immune stimulation in mice. J Pharmacol Exp Ther. Feb. 2000;292(2):468-79.
Iwaki et al., Preparation of Chiral Stationary Phase via Activated Carbamate Intermediate for Liquid Chromatographic Optical Resolution. Chromatographia. Oct. 1987;23:727-30.
Jain et al., Current ADC Linker Chemistry. Pharm Res. Nov. 2015;32(11):3526-40. Epub Mar. 11, 2015.
Jearawiriyapaisarn et al., Sustained Dystrophin Expression Induced by Peptide-conjugated Morpholino Oligomers in the Muscles of mdx Mice. Mol Ther. Sep. 2008;16(9):1624-9. doi: 10.1038/mt.2008.120. Epub Jun. 10, 2008.
Jirka et al., Cyclic Peptides to Improve Delivery and Exon Skipping of Antisense Oligonucleotides in a Mouse Model for Duchenne Muscular Dystrophy. Mol Ther. Jan. 3, 2018;26(1):132-147. doi: 10.1016/j.ymthe.2017.10.004. Epub Oct. 12, 2017.
Juliano, The delivery of therapeutic oligonucleotides. Nucleic Acids Res. Aug. 19, 2016;44(14):6518-48. doi: 10.1093/nar/gkw236. Epub Apr. 15, 2016.
Khan, Corticosteroid therapy in Duchenne muscular dystrophy. J Neurol Sci. Dec. 1, 1993;120(1):8-14.
Kinali et al., Local restoration of dystrophin expression with the morpholino oligomer AVI-4658 in Duchenne muscular dystrophy: a single-blind, placebo-controlled, dose-escalation, proof-of-concept study. Lancet Neurol. Oct. 2009;8(10):918-28. doi: 10.1016/S1474-4422(09)70211-X. Epub Aug. 25, 2009. Erratum in: Lancet Neurol. Dec. 2009;8(12):1083.
Kline et al., Methods to Make Homogenous Antibody Drug Conjugates. Pharm Res. Nov. 2015;32(11):3480-93. Epub Dec. 16, 2014.
Kuran et al., Investigations on the Catalytic Systems Diethylzinc/Di- and Trihydroxybenzenes in the Copolymerization of Carbon Dioxide with Propylene Oxide. Makromol. Chem. 1976;177:1283-92.
Lai et al., Mechanism of action and spectrum of cell lines sensitive to a doxorubicin-transferrin conjugate. Cancer Chemother Pharmacol. 1998;41(2):155-60. doi: 10.1007/s002800050722.
Lawrence et al., Crystal structure of the ectodomain of human transferrin receptor. Science. Oct. 22, 1999;286(5440):779-82. doi: 10.1126/science.286.5440.779.
Lee et al., RNase H-mediated degradation of toxic RNA in myotonic dystrophy type 1. Proc Natl Acad Sci U S A. Mar. 13, 2012;109(11):4221-6. doi: 10.1073/pnas.1117019109. Epub Feb. 27, 2012.
Lennox et al., Cellular localization of long non-coding RNAs affects silencing by RNAi more than by antisense oligonucleotides. Nucleic Acids Res. Jan. 29, 2016;44(2):863-77. doi: 10.1093/nar/gkv1206. Epub Nov. 17, 2015.

(56) References Cited

OTHER PUBLICATIONS

Lesley et al., Selection of cell lines resistant to anti-transferrin receptor antibody: evidence for a mutation in transferrin receptor. Mol Cell Biol. Sep. 1984;4(9):1675-81. doi: 10.1128/mcb.4.9.1675-1681.1984.

Levin, Targeting Therapeutic Oligonucleotides. N Engl J Med. Jan. 5, 2017;376(1):86-88. doi: 10.1056/NEJMcibr1613559.

Liang et al., Targeted delivery of plasmid DNA to myogenic cells via transferrin-conjugated peptide nucleic acid. Mol Ther. Mar. 2000;1(3):236-43. doi: 10.1006/mthe.2000.0043.

Liu, Exploring cell type-specific internalizing antibodies for targeted delivery of siRNA. Brief Funct Genomic Proteomic. Jun. 2007;6(2):112-9. doi: 10.1093/bfgp/elm015. Epub Jul. 31, 2007.

Lu et al., Functional amounts of dystrophin produced by skipping the mutated exon in the mdx dystrophic mouse. Nat Med. Aug. 2003;9(8):1009-14. Epub Jul. 6, 2003.

Lu et al., Systemic delivery of antisense oligoribonucleotide restores dystrophin expression in body-wide skeletal muscles. Proc Natl Acad Sci U S A. Jan. 4, 2005;102(1):198-203. doi: 10.1073/pnas.0406700102. Epub Dec. 17, 2004.

Luria-Perez et al., Antibody-mediated targeting of the transferrin receptor in cancer cells. Bol Med Hosp Infant Mex. Nov.-Dec. 2016;73(6):372-379. doi: 10.1016/j.bmhimx.2016.11.004. Epub Dec. 13, 2016.

Mann et al., Antisense-induced exon skipping and synthesis of dystrophin in the mdx mouse. Proc Natl Acad Sci U S A. Jan. 2, 2001;98(1):42-7.

Manzur et al., Update on the management of Duchenne muscular dystrophy. Arch Dis Child. Nov. 2008;93(11):986-90. doi: 10.1136/adc.2007.118141. Epub Jul. 30, 2008.

Masters et al., Clinical toxicity of antibody drug conjugates: a meta-analysis of payloads. Invest New Drugs. Feb. 2018;36(1):121-135. doi: 10.1007/s10637-017-0520-6. Epub Oct. 13, 2017.

Meeuwissen et al., Cofactor regeneration in polymersome nanoreactors: Enzymatically catalysed Baeyer-Villiger reactions. Journal of Materials Chemistry. Dec. 2011;21(47):18923-6.

Mojsov et al., A Quantitative Evaluation of Methods for Coupling Asparagine. The Journal of Organic Chemistry. Feb. 1980;45(4):555-60.

Murray et al., Human Biochemistry. "Mir." Moscow. 1993; 1:34. 5 pages (including English translation).

Naylor et al., DELIVER, a randomized, double-blind, placebo controlled, multiple ascending dose study of DYNE-251 in boys with DMD amenable to Exon 51 skipping. Poster. Presented at the Muscular Dystrophy Association Clinical and Scientific Conference. Mar. 19-22, 2023. 1 page.

Naylor et al., DELIVER, a randomized, double-blind, placebo controlled, multiple ascending dose study of DYNE-251 in boys with DMD amenable to Exon 51 skipping. Abstract. Mar. 2023. 1 page.

Nguyen et al., Antisense oligonucleotides for the treatment of cardiomyopathy in Duchenne muscular dystrophy. Am J Transl Res. Mar. 15, 2019;11(3):1202-1218.

Novak et al., Myoblasts and macrophages are required for therapeutic morpholino antisense oligonucleotide delivery to dystrophic muscle. Nat Commun. Oct. 16, 2017;8(1):941. doi: 10.1038/s41467-017-00924-7. Erratum in: Nat Commun. Jan. 15, 2018;9(1):208. Erratum in: Nat Commun. Mar. 23, 2018;9(1):1256.

Nowak et al., Duchenne muscular dystrophy and dystrophin: pathogenesis and opportunities for treatment. EMBO Rep. Sep. 2004;5(9):872-6.

Padlan et al., A possible procedure for reducing the immunogenicity of antibody variable domains while preserving their ligand-binding properties. Molecular Immunology. Apr.-May 1991;28(4-5):489-98.

Panowski et al., Site-specific antibody drug conjugates for cancer therapy. MAbs. Jan.-Feb. 2014;6(1):34-45.

Picariello et al., Dyne-101 achieves durable knockdown of toxic human nuclear DMPK RNA and correction of splicing in the hTfR1/DMSXL mouse model of DM1. Presented at the Muscular Dystrophy Association Clinical and Scientific Conference. Mar. 13-16, 2022. 1 page.

Pradeepkumar, Chemically modified oligonucleotides: synthesis, physicochemical and biochemical properties of their duplexes with DNA and RNA. Comprehensive Summaries of Uppsala Dissertations from the Faculty of Science and Technology. 2004; 973: 56 pages.

Pradhan et al., Prednisolone in Duchenne muscular dystrophy with imminent loss of ambulation. J Neurol. Oct. 2006;253(10):1309-16. doi: 10.1007/s00415-006-0212-1. Epub Jun. 19, 2006.

Qian et al., Targeted drug delivery via the transferrin receptor-mediated endocytosis pathway. Pharmacol Rev. Dec. 2002;54(4):561-87. doi: 10.1124/pr.54.4.561.

Rando et al., Rescue of dystrophin expression in mdx mouse muscle by RNA/DNA oligonucleotides. Proc Natl Acad Sci U S A. May 9, 2000;97(10):5363-8. doi: 10.1073/pnas.97.10.5363.

Roberts et al., Advances in oligonucleotide drug delivery. Nat Rev Drug Discov. Oct. 2020; 19(10):673-694. doi: 10.1038/s41573-020-0075-7. Epub Aug. 11, 2020.

Roberts et al., The Halogenation of Ethylenes. J. Am. Chem. Soc. May 1937;59(5):947-8.

Sahenk et al., The muscular dystrophies: distinct pathogenic mechanisms invite novel therapeutic approaches. Curr Rheumatol Rep. Jun. 2011;13(3):199-207.

Saito et al., Antisense PMO found in dystrophic dog model was effective in cells from exon 7-deleted DMD patient. PLoS One. Aug. 18, 2010;5(8):e12239.

Samoylova et al., Elucidation of muscle-binding peptides by phage display screening. Muscle Nerve. Apr. 1999;22(4):460-6.

Sazani et al., Safety pharmacology and genotoxicity evaluation of AVI-4658. Int J Toxicol. Mar.-Apr. 2010;29(2):143-56. doi: 10.1177/1091581809359206. Epub Jan. 28, 2010.

Schneider et al., Structural features of the cell surface receptor for transferrin that is recognized by the monoclonal antibody OKT9. J Biol Chem. Jul. 25, 1982;257(14):8516-22.

Schnyder et al., Targeting of skeletal muscle in vitro using biotinylated immunoliposomes. Biochem J. Jan. 1, 2004;377(Pt 1):61-7. doi: 10.1042/BJ20031034.

Setten et al., The current state and future directions of RNAi-based therapeutics. Nat Rev Drug Discov. Jun. 2019;18(6):421-446. doi: 10.1038/s41573-019-0017-4.

Shen et al., Chemistry, mechanism and clinical status of antisense oligonucleotides and duplex RNAs. Nucleic Acids Res. Feb. 28, 2018;46(4):1584-1600.

Shimizu-Motohashi et al., Exon skipping for Duchenne muscular dystrophy: a systematic review and meta-analysis. Orphanet J Rare Dis. Jun. 15, 2018;13(1):93.

Singh et al., Catalytic Enantioselective Cyclopropanation of Olefins Using Carbenoid Chemistry. Synthesis. Feb. 1997;137-49.

Sklar et al., Methylprednisolone increases dystrophin levels by inhibiting myotube death during myogenesis of normal human muscle in vitro. J Neurol Sci. Jan. 1991;101(1):73-81. doi: 10.1016/0022-510x(91)90019-4.

Stocki et al., Blood-brain barrier transport using a high affinity, brain-selective VNAR antibody targeting transferrin receptor 1. FASEB J. Feb. 2021;35(2):e21172. doi: 10.1096/fj.202001787R. Epub Nov. 25, 2020.

Subramanian et al., Abstract 1074. Targeted delivery of oligonucleotide therapeutics to muscle demonstrates potential to treat duchenne muscular dystrophy. Abstract. Mol Ther. 28 (4S1): 465. (2020) 1 page.

Sugo et al., Development of antibody-siRNA conjugate targeted to cardiac and skeletal muscles. J Control Release. Sep. 10, 2016;237:1-13. doi: 10.1016/j.jconrel.2016.06.036. Epub Jun. 29, 2016.

Summerton et al.. Morpholino antisense oligomers: design, preparation, and properties. Antisense Nucleic Acid Drug Dev. Jun. 1997;7(3):187-95.

Swayze et al., The medicinal chemistry of oligonucleotides. In: Antisense Drug Technology, Second Edition. 2007. Crooke, Ed. Chapter 6: 143-182.

Trollet et al., Gene therapy for muscular dystrophy: current progress and future prospects. Expert Opin Biol Ther. Jul. 2009;9(7):849-66.

(56) References Cited

OTHER PUBLICATIONS

Tron et al., Click chemistry reactions in medicinal chemistry: applications of the 1,3-dipolar cycloaddition between azides and alkynes. Med Res Rev. Mar. 2008;28(2):278-308.
Trowbridge et al., Anti-transferrin receptor monoclonal antibody and toxin-antibody conjugates affect growth of human tumour cells. Nature. Nov. 12, 1981;294(5837):171-3. doi: 10.1038/294171a0.
Van Den Bergen et al., Forty-Five Years of Duchenne Muscular Dystrophy in the Netherlands. J Neuromuscul Dis. 2014; 1(1):99-109.
Van Deutekom et al., Local dystrophin restoration with antisense oligonucleotide PRO051. N Engl J Med. Dec. 27, 2007;357(26):2677-86. doi: 10.1056/NEJMoa073108.
Van Deutekom, Abstract—The Development of RNA-Modulating Therapies. RNA & Oligonucleotide Therapeutics. Cold Spring Harbor Laboratory. Cold Spring Harbor, NY. Apr. 7-10, 2010:3. 19 pages total.
Wagner et al., Transferrin-polycation conjugates as carriers for DNA uptake into cells. Proc Natl Acad Sci U S A. May 1990;87(9):3410-4. doi: 10.1073/pnas.87.9.3410.
Walker et al., Improved cellular delivery of antisense oligonucleotides using transferrin receptor antibody-oligonucleotide conjugates. Pharm Res. Oct. 1995;12(10):1548-53. doi: 10.1023/a:1016260110049.
Walles et al., ADME and Safety Aspects of Non-cleavable Linkers in Drug Discovery and Development. Curr Top Med Chem. 2017;17(32):3463-3475. doi: 10.2174/1568026618666180118153502.
Wilton et al., Antisense oligonucleotide-induced exon skipping across the human dystrophin gene transcript. Mol Ther. Jul. 2007;15(7):1288-96. doi: 10.1038/sj.mt.6300095. Epub Feb. 6, 2007.
Wilton et al., Antisense oligonucleotides, exon skipping and the dystrophin gene transcript. Acta Myol. Dec. 2005;24(3):222-9.
Wilton et al., Exon skipping and Duchenne muscular dystrophy: hope, hype and how feasible? Neurol India. Jul.-Sep. 2008;56(3):254-62. doi: 10.4103/0028-3886.43443.
Wolf et al., ACHIEVE trial, a randomized, placebo-controlled, multiple ascending dose study of Dyne-101 in individuals with myotonic dystrophy Type 1 (DM1). Abstract. Mar. 2023. 1 page.
Wolf et al., ACHIEVE trial, a randomized, placebo-controlled, multiple ascending dose study of Dyne-101 in individuals with myotonic dystrophy Type 1 (DM1). Presented at the Muscular Dystrophy Association Clinical and Scientific Conference. Poster. Mar. 19-22, 2023. 1 page.
Xia et al., Intravenous siRNA of brain cancer with receptor targeting and avidin-biotin technology. Pharm Res. Dec. 2007;24(12):2309-16. doi: 10.1007/s11095-007-9460-8. Epub Oct. 11, 2007.
Yao et al., Targeted Delivery of ASOs Demonstrates Potential to Treat Duchenne Muscular Dystrophy. Poster. Presented at ASGCT; May 12, 2020. 1 page.
Ye et al., Generation and functional characterization of the anti-transferrin receptor single-chain antibody-GAL4 (TfRscFv-GAL4) fusion protein. BMC Biotechnol. Nov. 28, 2012;12:91.
Yoshida et al., Evaluation of off-target effects of gapmer antisense oligonucleotides using human cells. Genes Cells. Dec. 2019;24(12):827-835. doi: 10.1111/gtc.12730. Epub Nov. 12, 2019.
Zanotti et al., Abstract 17. Repeat dosing with DYNE-101 is Well Tolerated and Leads to a Sustained Reduction of DMPK RNA expression in key muscles for DM1 pathology in hTfR1/DMSXL mice and NHPs. Abstract. Mol Ther. Apr. 2022; 30(4S1): 9.
Zanotti et al., Abstract 247. The Force™ platform achieves robust knock down of toxic human nuclear DMPK RNA and foci reduction in DM1 cells and in newly developed hTfR1/DMSXL mouse model. Mol Ther. 29(4S1): 127. Apr. 2021. 1 page.
Zanotti et al., Abstract 82. The Force™ platform delivers oligonucleotides to the brain in a DM1 mouse model and in NHPs. Mol Ther. Apr. 2023; 31(4S1): 44.
Zanotti et al., Abstract EP.233. The Force™ platform achieves durable knockdown of toxic human nuclear DMPK RNA and correction of splicing in the hTFR1/DMSXL mouse model. Neuromusc Disord. 2021; 31: S120.
Zanotti et al., DYNE-101 achieves durable knockdown of toxic human nuclear DMPK RNA and correction of splicing in the hTfR1/DMSXL mouse model of DM1. Abstract. Mar. 2022. 1 page.
Zanotti et al., The Force™ platform achieves durable knockdown of toxic human nuclear DMPK RNA and correction of splicing in the hTFR1/DMSXL mouse model. Presented at WMS Meeting. Sep. 20-24, 2021. 1 page.
Zanotti, Repeat dosing with DYNE-101 is Well Tolerated and Leads to a Sustained Reduction of DMPK RNA expression in key muscles for DM1 pathology in hTfR1/DMSXL mice and NHPs. Presented at American Society of Gene & Cell Therapy Conference. May 16, 2022. 15 pages.
Zanotti, The Force™ platform delivers oligonucleotides to the brain in a DM1 mouse model and in NHPs. Presented at American Society of Gene & Cell Therapy Conference. May 17, 2023. 16 pages.

* cited by examiner

MUSCLE TARGETING COMPLEXES AND USES THEREOF FOR TREATING DYSTROPHINOPATHIES

RELATED APPLICATIONS

This application is a continuation of U.S. application Ser. No. 18/609,032, filed Mar. 19, 2024, which is a continuation of U.S. application Ser. No. 18/495,086, filed Oct. 26, 2023, now U.S. Pat. No. 11,969,475, granted Apr. 30, 2024, which is a continuation-in-part of U.S. application Ser. No. 18/490,905, filed Oct. 20, 2023, now Abandoned, which is a continuation of U.S. application Ser. No. 18/181,795, filed Mar. 10, 2023, now U.S. Pat. No. 11,839,660, granted Dec. 12, 2023, which is a continuation of U.S. application Ser. No. 17/811,401, filed Jul. 8, 2022, now U.S. Pat. No. 11,672,872, granted Jun. 13, 2023, which claims priority under 35 U.S.C. § 119 (e) of U.S. Provisional Application No. 63/220,043, filed Jul. 9, 2021. U.S. application Ser. No. 18/495,086 is a continuation-in-part of U.S. application Ser. No. 18/349,631, filed Jul. 10, 2023, now U.S. Pat. No. 11,986,537, granted May 21, 2024, which is a continuation of U.S. application Ser. No. 17/811,370, filed Jul. 8, 2022, now U.S. Pat. No. 11,771,776, granted Oct. 3, 2023, which claims priority under 35 U.S.C. § 119 (c) of U.S. Provisional Application No. 63/220,262, filed Jul. 9, 2021. U.S. application Ser. No. 18/495,086 is a continuation-in-part of U.S. application Ser. No. 18/329,781, filed Jun. 6, 2023, now U.S. Pat. No. 11,844,843, granted Dec. 19, 2023, which is a continuation of U.S. application Ser. No. 18/063,795, filed Dec. 9, 2022, now U.S. Pat. No. 11,679,161, granted Jun. 20, 2023, which is a continuation of U.S. application Ser. No. 17/811,380, filed Jul. 8, 2022, now U.S. Pat. No. 11,638,761, granted May 2, 2023, which claims priority under 35 U.S.C. § 119 (c) of U.S. Provisional Application No. 63/220,155, filed Jul. 9, 2021. U.S. application Ser. No. 18/495,086 is a continuation-in-part of U.S. application Ser. No. 18/181,700, filed Mar. 10, 2023, now Abandoned, which is a continuation of U.S. application Ser. No. 17/811,424, filed Jul. 8, 2022, now U.S. Pat. No. 11,633,498, granted Apr. 25, 2023, which claims priority under 35 U.S.C. § 119 (c) of U.S. Provisional Application No. 63/220,144, filed Jul. 9, 2021. The contents of each of these applications are incorporated herein by reference in their entirety.

FIELD OF THE INVENTION

The present application relates to targeting complexes for delivering molecular payloads (e.g., oligonucleotides) to cells and uses thereof, particularly uses relating to treatment of disease.

REFERENCE TO AN ELECTRONIC SEQUENCE LISTING

The contents of the electronic sequence listing (D082470069US07-SEQ-ZJG.xml; Size: 2,661,686 bytes; and Date of Creation: Aug. 6, 2024) is herein incorporated by reference in its entirety.

BACKGROUND OF INVENTION

Dystrophinopathies are a group of distinct neuromuscular diseases that result from mutations in dystrophin gene. Dystrophinopathies include Duchenne muscular dystrophy, Becker muscular dystrophy, and X-linked dilated cardiomyopathy. Dystrophin (DMD) is a large gene, containing 79 exons and about 2.6 million total base pairs. Numerous mutations in DMD, including exonic frameshift, deletion, substitution, and duplicative mutations, are able to diminish the expression of functional dystrophin, leading to dystrophinopathies. One agent that targets exon 51 of human DMD, eteplirsen, has been preliminarily approved by the U.S. Food and Drug Administration (FDA) however its efficacy is still being evaluated.

SUMMARY OF INVENTION

According to some aspects, the disclosure provides complexes that target muscle cells for purposes of delivering molecular payloads to those cells. In some embodiments, complexes provided herein are particularly useful for delivering molecular payloads that increase or restore expression or activity of functional DMD. In some embodiments, complexes comprise oligonucleotide based molecular payloads that promote normal expression of functional DMD through an in-frame exon skipping mechanism or suppression of stop codons. In other embodiments, complexes are configured for delivering a mini-dystrophin gene or synthetic mRNA that increases or restores functional dystrophin activity. Accordingly, in some embodiments, complexes provided herein comprise muscle-targeting agents (e.g., muscle targeting antibodies) that specifically bind to receptors on the surface of muscle cells for purposes of delivering molecular payloads to the muscle cells. In some embodiments, the complexes are taken up into the cells via a receptor mediated internalization, following which the molecular payload may be released to perform a function inside the cells. For example, complexes engineered to deliver oligonucleotides may release the oligonucleotides such that the oligonucleotides can promote expression of functional DMD (e.g., through an exon skipping mechanism) in the muscle cells. In some embodiments, the oligonucleotides are released by endosomal cleavage of covalent linkers connecting oligonucleotides and muscle-targeting agents of the complexes.

One aspect of the present disclosure relates to a complex comprising an anti-transferrin receptor (TfR) antibody covalently linked to a molecular payload configured for promoting the expression or activity of a DMD gene, wherein the antibody comprises:
  (i) a heavy chain variable region (VH) comprising an amino acid sequence at least 95% identical to SEQ ID NO: 76; and/or a light chain variable region (VL) comprising an amino acid sequence at least 95% identical to SEQ ID NO: 75;
  (ii) a heavy chain variable region (VH) comprising an amino acid sequence at least 95% identical to SEQ ID NO: 69; and/or a light chain variable region (VL) comprising an amino acid sequence at least 95% identical to SEQ ID NO: 70;
  (iii) a heavy chain variable region (VH) comprising an amino acid sequence at least 95% identical to SEQ ID NO: 71; and/or a light chain variable region (VL) comprising an amino acid sequence at least 95% identical to SEQ ID NO: 70;
  (iv) a heavy chain variable region (VH) comprising an amino acid sequence at least 95% identical to SEQ ID NO: 72; and/or a light chain variable region (VL) comprising an amino acid sequence at least 95% identical to SEQ ID NO: 70;
  (v) a heavy chain variable region (VH) comprising an amino acid sequence at least 95% identical to SEQ ID NO: 73; and/or a light chain variable region (VL) comprising an amino acid sequence at least 95% identical to SEQ ID NO: 74;

(vi) a heavy chain variable region (VH) comprising an amino acid sequence at least 95% identical to SEQ ID NO: 73; and/or a light chain variable region (VL) comprising an amino acid sequence at least 95% identical to SEQ ID NO: 75;

(vii) a heavy chain variable region (VH) comprising an amino acid sequence at least 95% identical to SEQ ID NO: 76; and/or a light chain variable region (VL) comprising an amino acid sequence at least 95% identical to SEQ ID NO: 74;

(viii) a heavy chain variable region (VH) comprising an amino acid sequence at least 95% identical to SEQ ID NO: 77; and/or a light chain variable region (VL) comprising an amino acid sequence at least 95% identical to SEQ ID NO: 78;

(ix) a heavy chain variable region (VH) comprising an amino acid sequence at least 95% identical to SEQ ID NO: 79; and/or a light chain variable region (VL) comprising an amino acid sequence at least 95% identical to SEQ ID NO: 80; or (x) a heavy chain variable region (VH) comprising an amino acid sequence at least 95% identical to SEQ ID NO: 77; and/or a light chain variable region (VL) comprising an amino acid sequence at least 95% identical to SEQ ID NO: 80.

In some embodiments, the antibody comprises:
(i) a VH comprising the amino acid sequence of SEQ ID NO: 76 and a VL comprising the amino acid sequence of SEQ ID NO: 75;
(ii) a VH comprising the amino acid sequence of SEQ ID NO: 69 and a VL comprising the amino acid sequence of SEQ ID NO: 70;
(iii) a VH comprising the amino acid sequence of SEQ ID NO: 71 and a VL comprising the amino acid sequence of SEQ ID NO: 70;
(iv) a VH comprising the amino acid sequence of SEQ ID NO: 72 and a VL comprising the amino acid sequence of SEQ ID NO: 70;
(v) a VH comprising the amino acid sequence of SEQ ID NO: 73 and a VL comprising the amino acid sequence of SEQ ID NO: 74;
(vi) a VH comprising the amino acid sequence of SEQ ID NO: 73 and a VL comprising the amino acid sequence of SEQ ID NO: 75;
(vii) a VH comprising the amino acid sequence of SEQ ID NO: 76 and a VL comprising the amino acid sequence of SEQ ID NO: 74;
(viii) a VH comprising the amino acid sequence of SEQ ID NO: 77 and a VL comprising the amino acid sequence of SEQ ID NO: 78;
(ix) a VH comprising the amino acid sequence of SEQ ID NO: 79 and a VL comprising the amino acid sequence of SEQ ID NO: 80; or
(x) a VH comprising the amino acid sequence of SEQ ID NO: 77 and a VL comprising the amino acid sequence of SEQ ID NO: 80.

In some embodiments, the antibody is selected from the group consisting of a Fab fragment, a Fab' fragment, a F(ab')2 fragment, a scFv, a Fv, and a full-length IgG. In some embodiments, the antibody is a Fab fragment.

In some embodiments, the antibody comprises:
(i) a heavy chain comprising an amino acid sequence at least 85% identical to SEQ ID NO: 101; and/or a light chain comprising an amino acid sequence at least 85% identical to SEQ ID NO: 90;

(ii) a heavy chain comprising an amino acid sequence at least 85% identical to SEQ ID NO: 97; and/or a light chain comprising an amino acid sequence at least 85% identical to SEQ ID NO: 85;

(iii) a heavy chain comprising an amino acid sequence at least 85% identical to SEQ ID NO: 98; and/or a light chain comprising an amino acid sequence at least 85% identical to SEQ ID NO: 85;

(iv) a heavy chain comprising an amino acid sequence at least 85% identical to SEQ ID NO: 99; and/or a light chain comprising an amino acid sequence at least 85% identical to SEQ ID NO: 85;

(v) a heavy chain comprising an amino acid sequence at least 85% identical to SEQ ID NO: 100; and/or a light chain comprising an amino acid sequence at least 85% identical to SEQ ID NO: 89;

(vi) a heavy chain comprising an amino acid sequence at least 85% identical to SEQ ID NO: 100; and/or a light chain comprising an amino acid sequence at least 85% identical to SEQ ID NO: 90;

(vii) a heavy chain comprising an amino acid sequence at least 85% identical to SEQ ID NO: 101; and/or a light chain comprising an amino acid sequence at least 85% identical to SEQ ID NO: 89;

(viii) a heavy chain comprising an amino acid sequence at least 85% identical to SEQ ID NO: 102; and/or a light chain comprising an amino acid sequence at least 85% identical to SEQ ID NO: 93;

(ix) a heavy chain comprising an amino acid sequence at least 85% identical to SEQ ID NO: 103; and/or a light chain comprising an amino acid sequence at least 85% identical to SEQ ID NO: 95; or (x) a heavy chain comprising an amino acid sequence at least 85% identical to SEQ ID NO: 102; and/or a light chain comprising an amino acid sequence at least 85% identical to SEQ ID NO: 95.

In some embodiments, the antibody comprises:
(i) a heavy chain comprising the amino acid sequence of SEQ ID NO: 101; and a light chain comprising the amino acid sequence of SEQ ID NO: 90;
(ii) a heavy chain comprising the amino acid sequence of SEQ ID NO: 97; and a light chain comprising the amino acid sequence of SEQ ID NO: 85;
(iii) a heavy chain comprising the amino acid sequence of SEQ ID NO: 98; and a light chain comprising the amino acid sequence of SEQ ID NO: 85;
(iv) a heavy chain comprising the amino acid sequence of SEQ ID NO: 99; and a light chain comprising the amino acid sequence of SEQ ID NO: 85;
(v) a heavy chain comprising the amino acid sequence of SEQ ID NO: 100; and a light chain comprising the amino acid sequence of SEQ ID NO: 89;
(vi) a heavy chain comprising the amino acid sequence of SEQ ID NO: 100; and a light chain comprising the amino acid sequence of SEQ ID NO: 90;
(vii) a heavy chain comprising the amino acid sequence of SEQ ID NO: 101;
and a light chain comprising the amino acid sequence of SEQ ID NO: 89;
(viii) a heavy chain comprising the amino acid sequence of SEQ ID NO: 102;
and a light chain comprising the amino acid sequence of SEQ ID NO: 93;

(ix) a heavy chain comprising the amino acid sequence of SEQ ID NO: 103; and a light chain comprising the amino acid sequence of SEQ ID NO: 95; or (x) a heavy chain comprising the amino acid sequence of SEQ ID NO: 102; and a light chain comprising the amino acid sequence of SEQ ID NO: 95.

In some embodiments, the antibody does not specifically bind to the transferrin binding site of the transferrin receptor and/or the muscle-targeting antibody does not inhibit binding of transferrin to the transferrin receptor.

In some embodiments, the molecular payload is an oligonucleotide. In some embodiments, the oligonucleotide promotes exon skipping in a DMD RNA. In some embodiments, the oligonucleotide promotes skipping of an exon of DMD in the range of exon 8 to exon 55. In some embodiments, the oligonucleotide promotes skipping of exon 8, exon 23, exon 43, exon 44, exon 45, exon 46, exon 50, exon 51, exon 52, exon 53, and/or exon 55.

In some embodiments, the oligonucleotide comprises a region of complementarity to one or more full or partial exonic splicing enhancers (ESE) of a DMD transcript. In some embodiments, the oligonucleotide comprises a region of complementarity to a target sequence comprising one or more full or partial ESEs as set forth in SEQ ID NOs: 402-436 and 2043-2238.

In some embodiments, the oligonucleotide promotes skipping of exon 51.

In some embodiments, the oligonucleotide is 20-30 nucleotides in length and comprises a region of complementarity to a target sequence comprising at least 4 consecutive nucleotides of an ESE as set forth in any one of SEQ ID NOs: 402-436.

In some embodiments, the oligonucleotide comprises any one of SEQ ID NOS: 437-1241, or comprises a region of complementarity to any one of SEQ ID NOs: 1242-2046.

In some embodiments, the oligonucleotide comprises a region of complementarity to a target sequence of an oligonucleotide listed in Table 14. In some embodiments, the oligonucleotide comprises a sequence listed in Table 14, wherein any one or more of the uracil bases (U's) in the oligonucleotide may optionally be a thymine base (T).

In some embodiments, the oligonucleotide comprises at least one modified internucleoside linkage. In some embodiments, the at least one modified internucleoside linkage is a phosphorothioate linkage.

In some embodiments, the oligonucleotide comprises one or more modified nucleosides. In some embodiments, the one or more modified nucleosides are 2'-modified nucleosides.

In some embodiments, the oligonucleotide comprises one or more phosphorodiamidate morpholinos, optionally wherein the oligonucleotide is a phosphorodiamidate morpholino oligomer (PMO).

In some embodiments, the antibody is covalently linked to the molecular payload via a cleavable linker. In some embodiments, the cleavable linker comprises a valine-citrulline sequence.

In some embodiments, the antibody is covalently linked to the molecular payload via conjugation to a lysine residue or a cysteine residue of the antibody.

Another aspect of the present disclosure relates to a method of promoting the expression or activity of a DMD protein in a cell, the method comprising contacting the cell with a complex disclosed herein in an amount effective for promoting internalization of the molecular payload to the cell, optionally wherein the cell is a muscle cell.

Another aspect of the present disclosure relates to a method of treating a subject having a mutated DMD allele that is associated with a dystrophinopathy, the method comprising administering to the subject an effective amount of a complex disclosed herein.

BRIEF DESCRIPTION OF THE DRAWINGS

FIG. 9A shows binding of humanized 3M12 variants to hTfR1. FIG. 9B shows binding of humanized 3M12 variants to cTfR1. FIG. 9C shows binding of humanized 3A4 variants to hTfR1. FIG. 9D shows binding of humanized 3A4 variants to cTfR1. FIG. 9E shows binding of humanized 5H12 variants to hTfR1. FIG. 9F shows binding of humanized 5H12 variants to hTfR1.

FIG. 11A shows the binding of humanized 3M12 variants alone or in conjugates with a DMPK targeting oligo to hTfR1. FIG. 11B shows the binding of humanized 3M12 variants alone or in conjugates with a DMPK targeting oligo to cTfR1. FIG. 11C shows the binding of humanized 3A4 variants alone or in conjugates with a DMPK targeting oligo to hTfR1. FIG. 11D shows the binding of humanized 3A4 variants alone or in conjugates with a DMPK targeting oligo to cTfR1. FIG. 11E shows the binding of humanized 5H12 variants alone or in conjugates with a DMPK targeting oligo to hTfR1. FIG. 11F shows the binding of humanized 5H12 variants alone or in conjugates with a DMPK targeting oligo to cTfR1. The respective $EC_{50}$ values are also shown.

FIG. 22A shows western blots of dystrophin and alpha-actinin protein in muscle tissue two weeks following injection of ASO or Ab-ASO. FIG. 22B shows quantification of the dystrophin in the western blot of FIG. 23A relative to dystrophin protein in wild-type muscle. FIG. 22C shows western blots of dystrophin and alpha-actinin protein in muscle tissue four weeks following injection of ASO or Ab-ASO. FIG. 22D shows quantification of the dystrophin in the western blot of FIG. 22C relative to dystrophin protein in wild-type muscle. The standard curves in FIGS. 22A and 22C were generated by pooling tissue from wild-type (WT) and mdx mouse samples, and the percent WT indicates the amount of WT protein spiked into each sample. ($*p<0.05$; ns, not significant)

FIG. 23A shows western blots of dystrophin and alpha-actinin protein in muscle tissue two weeks following injection of ASO or Ab-ASO. FIG. 23B shows quantification of the dystrophin in the western blot of FIG. 23A relative to dystrophin protein in wild-type muscle. FIG. 23C shows western blots of dystrophin and alpha-actinin protein in muscle tissue four weeks following injection of ASO or Ab-ASO. FIG. 23D shows quantification of the dystrophin in the Western blot of FIG. 23C relative to dystrophin protein in wild-type muscle. The standard curves in FIGS. 23A and 23C were generated by pooling tissue from wild-type (WT) and mdx mouse samples, and the percent WT indicates the amount of WT protein spiked into each sample. ($*p<0.05$, $****p<0.0001$)

FIG. 24A shows western blots of dystrophin and alpha-actinin protein in muscle tissue two weeks following injection of ASO or Ab-ASO. FIG. 24B shows quantification of the dystrophin in the western blot of FIG. 24A relative to dystrophin protein in wild-type muscle. FIG. 24C shows western blots of dystrophin and alpha-actinin protein in muscle tissue four weeks following injection of ASO or Ab-ASO. FIG. 24D shows quantification of the dystrophin in the Western blot of FIG. 24C relative to dystrophin protein in wild-type muscle. The standard curves in FIGS. 24A and 24C were generated by pooling tissue from wild-type (WT) and mdx mouse samples, and the percent WT indicates the amount of WT protein spiked into each sample. ($p<0.01$, $*p<0.001$)

DETAILED DESCRIPTION OF INVENTION

Figure 1:
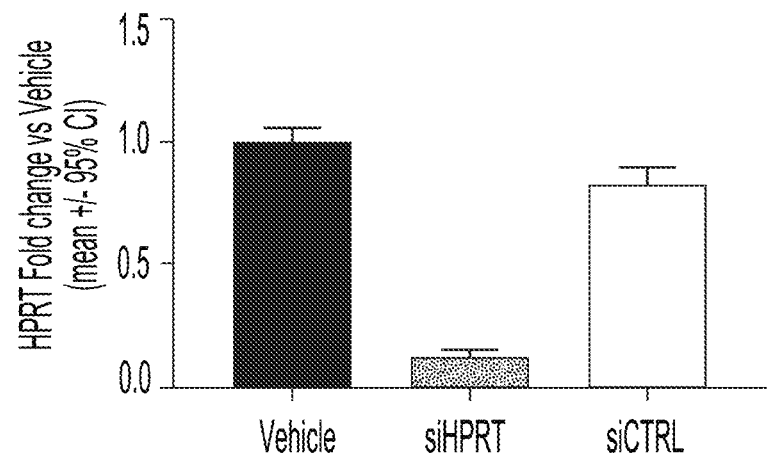
FIG. 1 depicts a non-limiting schematic showing the effect of transfecting cells with an siRNA.

Aspects of the disclosure relate to a recognition that while certain molecular payloads (e.g., oligonucleotides, peptides, small molecules) can have beneficial effects in muscle cells, it has proven challenging to effectively target such cells. As described herein, the present disclosure provides complexes comprising muscle-targeting agents covalently linked to molecular payloads in order to overcome such challenges. In some embodiments, the complexes are particularly useful for delivering molecular payloads that modulate (e.g., promote) the expression or activity of target genes in muscle cells, e.g., in a subject having or suspected of having a rare muscle disease. For example, in some embodiments, complexes are provided for targeting DMD, e.g., a mutated DMD allele. In some embodiments, complexes provided herein may comprise oligonucleotides that promote normal expression and activity of DMD. As another example, complexes may comprise oligonucleotides that induce skipping of exon of DMD mRNA. In some embodiments, synthetic nucleic acid payloads (e.g., DNA or RNA payloads) may be used that express one or more proteins that promote normal expression and activity of DMD.

In some embodiments, complexes may comprise molecular payloads of synthetic cDNAs and/or (e.g., and) synthetic mRNAs, e.g., that express dystrophin or fragments thereof (e.g., a dystrophin mini gene). In some embodiments, complexes may comprise molecular payloads such as guide molecules (e.g., guide RNAs) that are capable of targeting nucleic acid programmable nucleases (e.g., Cas9) to a sequence at or near a disease-associated mutation of DMD, e.g., a mutated DMD exon. In some embodiments, such nucleic programmable nucleases could be used to cleave part or all of a disease-associated mutation of DMD, e.g., a mutated DMD exon, to promote expression of functional DMD. In some embodiments, complexes may comprise molecular payloads that upregulate the expression and/or (e.g., and) activity of genes that can replace the function of dystrophin, such as utrophin.

Further aspects of the disclosure, including a description of defined terms, are provided below.

I. Definitions

Administering: As used herein, the terms "administering" or "administration" means to provide a complex to a subject in a manner that is physiologically and/or (e.g., and) pharmacologically useful (e.g., to treat a condition in the subject).

Approximately: As used herein, the term "approximately" or "about," as applied to one or more values of interest, refers to a value that is similar to a stated reference value. In certain embodiments, the term "approximately" or "about" refers to a range of values that fall within 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Antibody: As used herein, the term "antibody" refers to a polypeptide that includes at least one immunoglobulin variable domain or at least one antigenic determinant, e.g., paratope that specifically binds to an antigen. In some embodiments, an antibody is a full-length antibody. In some embodiments, an antibody is a chimeric antibody. In some embodiments, an antibody is a humanized antibody. However, in some embodiments, an antibody is a Fab fragment, a Fab' fragment, a F(ab')2 fragment, a Fv fragment or a scFv fragment. In some embodiments, an antibody is a nanobody derived from a camelid antibody or a nanobody derived from shark antibody. In some embodiments, an antibody is a diabody. In some embodiments, an antibody comprises a framework having a human germline sequence. In another embodiment, an antibody comprises a heavy chain constant domain selected from the group consisting of IgG, IgG1, IgG2, IgG2A, IgG2B, IgG2C, IgG3, IgG4, IgA1, IgA2, IgD, IgM, and IgE constant domains. In some embodiments, an antibody comprises a heavy (H) chain variable region (abbreviated herein as VH), and/or (e.g., and) a light (L) chain variable region (abbreviated herein as VL). In some embodiments, an antibody comprises a constant domain, e.g., an Fc region. An immunoglobulin constant domain refers to a heavy or light chain constant domain. Human IgG heavy chain and light chain constant domain amino acid sequences and their functional variations are known. With respect to the heavy chain, in some embodiments, the heavy chain of an antibody described herein can be an alpha ($\alpha$), delta ($\Delta$), epsilon ($\epsilon$), gamma ($\gamma$) or mu ($\mu$) heavy chain. In some embodiments, the heavy chain of an antibody described herein can comprise a human alpha ($\alpha$), delta ($\Delta$), epsilon ($\epsilon$), gamma ($\gamma$) or mu ($\mu$) heavy chain. In a particular embodiment, an antibody described herein comprises a human gamma 1 CH1, CH2, and/or (e.g., and) CH3 domain. In some embodiments, the amino acid sequence of the VH domain comprises the amino acid sequence of a human gamma (Y) heavy chain constant region, such as any known in the art. Non-limiting examples of human constant region sequences have been described in the art, e.g., see U.S. Pat. No. 5,693,780 and Kabat E A et al., (1991) supra. In some embodiments, the VH domain comprises an amino acid sequence that is at least 70%, 75%, 80%, 85%, 90%, 95%, 98%, or at least 99% identical to any of the variable chain constant regions provided herein. In some embodiments, an antibody is modified, e.g., modified via glycosylation, phosphorylation, sumoylation, and/or (e.g., and) methylation. In some embodiments, an antibody is a glycosylated antibody, which is conjugated to one or more sugar or carbohydrate molecules. In some embodiments, the one or more sugar or carbohydrate molecule are conjugated to the antibody via N-glycosylation, O-glycosylation, C-glycosylation, glypiation (GPI anchor attachment), and/or (e.g., and) phosphoglycosylation. In some embodiments, the one or more sugar or carbohydrate molecule are monosaccharides, disaccharides, oligosaccharides, or glycans. In some embodiments, the one or more sugar or carbohydrate molecule is a branched oligosaccharide or a branched glycan. In some embodiments, the one or more sugar or carbohydrate molecule includes a mannose unit, a glucose unit, an N-acetylglucosamine unit, an N-acetylgalactosamine unit, a galactose unit, a fucose unit, or a phospholipid unit. In some embodiments, an antibody is a construct that comprises a polypeptide comprising one or more antigen binding fragments of the disclosure linked to a linker polypeptide or an immunoglobulin constant domain. Linker polypeptides comprise two or more amino acid residues joined by peptide bonds and are used to link one or more antigen binding portions. Examples of linker polypeptides have been reported (see e.g., Holliger, P., et al. (1993) Proc. Natl. Acad. Sci. USA 90:6444-6448; Poljak, R. J., et al. (1994) Structure 2:1121-1123). Still further, an antibody may be part of a larger immunoadhesion molecule, formed by covalent or noncovalent association of the antibody or antibody portion with one or more other proteins or peptides. Examples of such immunoadhesion molecules include use of the streptavidin core region to make a tetrameric scFv molecule (Kipriyanov, S. M., et al. (1995) Human Antibodies and Hybridomas 6:93-101) and use of a cysteine residue, a marker peptide and a C-terminal polyhistidine tag to make bivalent and biotinylated scFv molecules (Kipriyanov, S. M., et al. (1994) Mol. Immunol. 31:1047-1058).

CDR: As used herein, the term "CDR" refers to the complementarity determining region within antibody variable sequences. A typical antibody molecule comprises a heavy chain variable region (VH) and a light chain variable region (VL), which are usually involved in antigen binding. The VH and VL regions can be further subdivided into regions of hypervariability, also known as "complementarity determining regions" ("CDR"), interspersed with regions that are more conserved, which are known as "framework regions" ("FR"). Each VH and VL is typically composed of three CDRs and four FRs, arranged from amino-terminus to carboxy-terminus in the following order: FR1, CDR1, FR2, CDR2, FR3, CDR3, FR4. The extent of the framework region and CDRs can be precisely identified using methodology known in the art, for example, by the Kabat definition, the IMGT definition, the Chothia definition, the AbM definition, and/or (e.g., and) the contact definition, all of which are well known in the art. Sec, e.g., Kabat, E. A., et al. (1991) Sequences of Proteins of Immunological Interest, Fifth Edition, U.S. Department of Health and Human Services, NIH Publication No. 91-3242; IMGT®, the international ImMunoGeneTics Information System® http://www.imgt.org, Lefranc, M.-P. et al., Nucleic Acids Res., 27:209-212 (1999); Ruiz, M. et al., Nucleic Acids Res., 28:219-221 (2000); Lefranc, M.-P., Nucleic Acids Res., 29:207-209 (2001); Lefranc, M.-P., Nucleic Acids Res., 31:307-310 (2003); Lefranc, M.-P. et al., In Silico Biol., 5, 0006 (2004) [Epub], 5:45-60 (2005); Lefranc, M.-P. et al., Nucleic Acids Res., 33: D593-597 (2005); Lefranc, M.-P. et al., Nucleic Acids Res., 37: D1006-1012 (2009); Lefranc, M.-P. et al., Nucleic Acids Res., 43: D413-422 (2015); Chothia et al., (1989) Nature 342:877; Chothia, C. et al. (1987) J. Mol. Biol. 196:901-917, Al-lazikani et al (1997) J. Molec. Biol. 273:927-948; and Almagro, J. Mol. Recognit. 17:132-143 (2004). See also hgmp.mrc.ac.uk and bioinf.org.uk/abs. As used herein, a CDR may refer to the CDR defined by any method known in the art. Two antibodies having the same CDR means that the two antibodies have the same amino acid sequence of that CDR as determined by the same method, for example, the IMGT definition.

There are three CDRs in each of the variable regions of the heavy chain and the light chain, which are designated CDR1, CDR2 and CDR3, for each of the variable regions. The term "CDR set" as used herein refers to a group of three CDRs that occur in a single variable region capable of binding the antigen. The exact boundaries of these CDRs have been defined differently according to different systems. The system described by Kabat (Kabat et al., Sequences of Proteins of Immunological Interest (National Institutes of Health, Bethesda, Md. (1987) and (1991)) not only provides an unambiguous residue numbering system applicable to any variable region of an antibody, but also provides precise residue boundaries defining the three CDRs. These CDRs may be referred to as Kabat CDRs. Sub-portions of CDRs may be designated as L1, L2 and L3 or H1, H2 and H3 where the "L" and the "H" designates the light chain and the heavy chains regions, respectively. These regions may be referred to as Chothia CDRs, which have boundaries that overlap with Kabat CDRs. Other boundaries defining CDRs overlapping with the Kabat CDRs have been described by Padlan (FASEB J. 9:133-139 (1995)) and MacCallum (J Mol Biol 262 (5): 732-45 (1996)). Still other CDR boundary definitions may not strictly follow one of the above systems, but will nonetheless overlap with the Kabat CDRs, although they may be shortened or lengthened in light of prediction or experimental findings that particular residues or groups of residues or even entire CDRs do not significantly impact antigen binding. The methods used herein may utilize CDRs defined according to any of these systems. Examples of CDR definition systems are provided in Table 1.

TABLE 1

CDR Definitions

| | IMGT[1] | Kabat[2] | Chothia[3] |
|---|---|---|---|
| CDR-H1 | 27-38 | 31-35 | 26-32 |
| CDR-H2 | 56-65 | 50-65 | 53-55 |
| CDR-H3 | 105-116/117 | 95-102 | 96-101 |
| CDR-L1 | 27-38 | 24-34 | 26-32 |
| CDR-L2 | 56-65 | 50-56 | 50-52 |
| CDR-L3 | 105-116/117 | 89-97 | 91-96 |

[1]IMGT ®, the international ImMunoGeneTics information system ®, imgt.org, Lefranc, M.-P. et al., Nucleic Acids Res., 27: 209-212 (1999)
[2]Kabat et al. (1991) Sequences of Proteins of Immunological Interest, Fifth Edition, U.S. Department of Health and Human Services, NIH Publication No. 91-3242
[3]Chothia et al., J. Mol. Biol. 196: 901-917 (1987))

CDR-grafted antibody: The term "CDR-grafted antibody" refers to antibodies which comprise heavy and light chain variable region sequences from one species but in which the sequences of one or more of the CDR regions of VH and/or (e.g., and) VL are replaced with CDR sequences of another species, such as antibodies having murine heavy and light chain variable regions in which one or more of the murine CDRs (e.g., CDR3) has been replaced with human CDR sequences.

Chimeric antibody: The term "chimeric antibody" refers to antibodies which comprise heavy and light chain variable region sequences from one species and constant region sequences from another species, such as antibodies having murine heavy and light chain variable regions linked to human constant regions.

Complementary: As used herein, the term "complementary" refers to the capacity for precise pairing between two nucleotides or two sets of nucleotides. In particular, complementary is a term that characterizes an extent of hydrogen bond pairing that brings about binding between two nucleotides or two sets of nucleotides. For example, if a base at one position of an oligonucleotide is capable of hydrogen bonding with a base at the corresponding position of a target nucleic acid (e.g., an mRNA), then the bases are considered to be complementary to each other at that position. Base pairings may include both canonical Watson-Crick base pairing and non-Watson-Crick base pairing (e.g., Wobble base pairing and Hoogsteen base pairing). For example, in some embodiments, for complementary base pairings, adenosine-type bases (A) are complementary to thymidine-type bases (T) or uracil-type bases (U), that cytosine-type bases (C) are complementary to guanosine-type bases (G), and that universal bases such as 3-nitropyrrole or 5-nitroindole can hybridize to and are considered complementary to any A, C, U, or T. Inosine (I) has also been considered in the art to be a universal base and is considered complementary to any A, C, U or T.

Conservative amino acid substitution: As used herein, a "conservative amino acid substitution" refers to an amino acid substitution that does not alter the relative charge or size characteristics of the protein in which the amino acid substitution is made. Variants can be prepared according to methods for altering polypeptide sequence known to one of ordinary skill in the art such as are found in references which compile such methods, e.g. Molecular Cloning: A Laboratory Manual, J. Sambrook, et al., eds., Fourth Edition, Cold Spring Harbor Laboratory Press, Cold Spring Harbor, New York, 2012, or Current Protocols in Molecular Biology, F. M. Ausubel, et al., eds., John Wiley & Sons, Inc., New York. Conservative substitutions of amino acids include substitutions made amongst amino acids within the following groups: (a) M, I, L, V; (b) F, Y, W; (c) K, R, H; (d) A, G; (c) S, T; (f) Q, N; and (g) E, D.

Covalently linked: As used herein, the term "covalently linked" refers to a characteristic of two or more molecules being linked together via at least one covalent bond. In some embodiments, two molecules can be covalently linked together by a single bond, e.g., a disulfide bond or disulfide bridge, that serves as a linker between the molecules. However, in some embodiments, two or more molecules can be covalently linked together via a molecule that serves as a linker that joins the two or more molecules together through multiple covalent bonds. In some embodiments, a linker may be a cleavable linker. However, in some embodiments, a linker may be a non-cleavable linker.

Cross-reactive: As used herein and in the context of a targeting agent (e.g., antibody), the term "cross-reactive," refers to a property of the agent being capable of specifically binding to more than one antigen of a similar type or class (e.g., antigens of multiple homologs, paralogs, or orthologs) with similar affinity or avidity. For example, in some embodiments, an antibody that is cross-reactive against human and non-human primate antigens of a similar type or class (e.g., a human transferrin receptor and non-human primate transferrin receptor) is capable of binding to the human antigen and non-human primate antigens with a similar affinity or avidity. In some embodiments, an antibody is cross-reactive against a human antigen and a rodent antigen of a similar type or class. In some embodiments, an antibody is cross-reactive against a rodent antigen and a non-human primate antigen of a similar type or class. In some embodiments, an antibody is cross-reactive against a human antigen, a non-human primate antigen, and a rodent antigen of a similar type or class.

DMD: As used herein, the term "DMD" refers to a gene that encodes dystrophin protein, a key component of the dystrophin-glycoprotein complex, which bridges the inner cytoskeleton and the extracellular matrix in muscle cells, particularly muscle fibers. Deletions, duplications, and point mutations in DMD may cause dystrophinopathies, such as Duchenne muscular dystrophy, Becker muscular dystrophy, or cardiomyopathy (e.g., DMD-associated dilated cardiomyopathy). Alternative promoter usage and alternative splicing result in numerous distinct transcript variants and protein isoforms for this gene. In some embodiments, a dystrophin gene may be a human (Gene ID: 1756), non-human primate (e.g., Gene ID: 465559), or rodent gene (e.g., Gene ID: 13405; Gene ID: 24907). In addition, multiple human transcript variants (e.g., as annotated under GenBank RefSeq Accession Numbers: NM_000109.3, NM_004006.2 (SEQ ID NO: 2239), NM_004009.3, NM_004010.3 and NM_004011.3) have been characterized that encode different protein isoforms.

DMD allele: As used herein, the term "DMD allele" refers to any one of alternative forms (e.g., wild-type or mutant forms) of a DMD gene. In some embodiments, a DMD allele may encode for dystrophin that retains its normal and typical functions. In some embodiments, a DMD allele may comprise one or more mutations that results in muscular dystrophy. Common mutations that lead to Duchenne muscular dystrophy involve frameshift, deletion, substitution, and duplicative mutations of one or more of 79 exons present in a dystrophin allele, e.g., exon 8, exon 23, exon 41, exon 44, exon 50, exon 51, exon 52, exon 53, or exon 55. Further examples of DMD mutations are disclosed, for example, in Flanigan K M, et al., *Mutational spectrum of DMD mutations in dystrophinopathy patients: application of modern diagnostic techniques to a large cohort*. Hum Mutat. 2009 December; 30 (12): 1657-66, the contents of which are incorporated herein by reference in its entirety.

Dystrophinopathy: As used herein, the term "dystrophinopathy" refers to a muscle disease that results from one or more mutated DMD alleles. Dystrophinopathies include a spectrum of conditions (ranging from mild to severe) that includes Duchenne muscular dystrophy, Becker muscular dystrophy, and DMD-associated dilated cardiomyopathy (DCM). In some embodiments, at one end of the spectrum, dystrophinopathy is phenotypically associated with an asymptomatic increase in serum concentration of creatine phosphokinase (CK) and/or (e.g., and) muscle cramps with myoglobinuria. In some embodiments, at the other end of the spectrum, dystrophinopathy is phenotypically associated with progressive muscle diseases that are generally classified as Duchenne or Becker muscular dystrophy when skeletal muscle is primarily affected and as DMD-associated dilated cardiomyopathy (DCM) when the heart is primarily affected. Symptoms of Duchenne muscular dystrophy include muscle loss or degeneration, diminished muscle function, pseudohypertrophy of the tongue and calf muscles, higher risk of neurological abnormalities, and a shortened lifespan. Duchenne muscular dystrophy is associated with Online Mendelian Inheritance in Man (OMIM) Entry #310200. Becker muscular dystrophy is associated with OMIM Entry #300376. Dilated cardiomyopathy is associated with OMIM Entry X #302045.

Exonic splicing enhancer (ESE): As used herein, the term "exonic splicing enhancer" or "ESE" refers to a nucleic acid sequence motif within an exon of a gene, pre-mRNA, or mRNA that directs or enhances splicing of pre-mRNA into mRNA, e.g., as described in Blencowe et al., Trends Biochem Sci 25, 106-10. (2000), incorporated herein by reference. ESEs may direct or enhance splicing, for example, to remove one or more introns and/or one or more exons from a gene transcript. ESE motifs are typically 6-8 nucleobases in length. SR proteins (e.g., proteins encoded by the gene SRSF1, SRSF2, SRSF3, SRSF4, SRSF5, SRSF6, SRSF7, SRSF8, SRSF9, SRSF10, SRSF11, SRSF12, TRA2A or TRA2B) bind to ESEs through their RNA recognition motif region to facilitate splicing. ESE motifs can be identified through a number of methods, including those described in Cartegni et al., Nucleic Acids Research, 2003, Vol. 31, No. 13, 3568-3571, incorporated herein by reference.

Framework: As used herein, the term "framework" or "framework sequence" refers to the remaining sequences of a variable region minus the CDRs. Because the exact definition of a CDR sequence can be determined by different systems, the meaning of a framework sequence is subject to correspondingly different interpretations. The six CDRs (CDR-L1, CDR-L2, and CDR-L3 of light chain and CDR-H1, CDR-H2, and CDR-H3 of heavy chain) also divide the framework regions on the light chain and the heavy chain into four sub-regions (FR1, FR2, FR3 and FR4) on each chain, in which CDR1 is positioned between FR1 and FR2, CDR2 between FR2 and FR3, and CDR3 between FR3 and FR4. Without specifying the particular sub-regions as FR1, FR2, FR3 or FR4, a framework region, as referred by others, represents the combined FRs within the variable region of a single, naturally occurring immunoglobulin chain. As used herein, a FR represents one of the four sub-regions, and FRs represents two or more of the four sub-regions constituting a framework region. Human heavy chain and light chain acceptor sequences are known in the art. In one embodiment, the acceptor sequences known in the art may be used in the antibodies disclosed herein.

Human antibody: The term "human antibody", as used herein, is intended to include antibodies having variable and constant regions derived from human germline immunoglobulin sequences. The human antibodies of the disclosure may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody", as used herein, is not intended to include antibodies in which CDR sequences derived from the germline of another mammalian species, such as a mouse, have been grafted onto human framework sequences.

Humanized antibody: The term "humanized antibody" refers to antibodies which comprise heavy and light chain variable region sequences from a non-human species (e.g., a mouse) but in which at least a portion of the VH and/or (e.g., and) VL sequence has been altered to be more "human-like", i.e., more similar to human germline variable sequences. One type of humanized antibody is a CDR-grafted antibody, in which human CDR sequences are introduced into non-human VH and VL sequences to replace the corresponding nonhuman CDR sequences. In one embodiment, humanized anti-transferrin receptor antibodies and antigen binding portions are provided. Such antibodies may be generated by obtaining murine anti-transferrin receptor monoclonal antibodies using traditional hybridoma technology followed by humanization using in vitro genetic engineering, such as those disclosed in Kasaian et al PCT publication No. WO 2005/123126 A2.

Internalizing cell surface receptor: As used herein, the term, "internalizing cell surface receptor" refers to a cell surface receptor that is internalized by cells, e.g., upon external stimulation, e.g., ligand binding to the receptor. In some embodiments, an internalizing cell surface receptor is internalized by endocytosis. In some embodiments, an internalizing cell surface receptor is internalized by clathrin-mediated endocytosis. However, in some embodiments, an internalizing cell surface receptor is internalized by a clathrin-independent pathway, such as, for example, phagocytosis, macropinocytosis, cavcolae- and raft-mediated uptake or constitutive clathrin-independent endocytosis. In some embodiments, the internalizing cell surface receptor comprises an intracellular domain, a transmembrane domain, and/or (e.g., and) an extracellular domain, which may optionally further comprise a ligand-binding domain. In some embodiments, a cell surface receptor becomes internalized by a cell after ligand binding. In some embodiments, a ligand may be a muscle-targeting agent or a muscle-targeting antibody. In some embodiments, an internalizing cell surface receptor is a transferrin receptor.

Isolated antibody: An "isolated antibody", as used herein, is intended to refer to an antibody that is substantially free of other antibodies having different antigenic specificities (e.g., an isolated antibody that specifically binds transferrin receptor is substantially free of antibodies that specifically bind antigens other than transferrin receptor). An isolated antibody that specifically binds transferrin receptor complex may, however, have cross-reactivity to other antigens, such as transferrin receptor molecules from other species. Moreover, an isolated antibody may be substantially free of other cellular material and/or (e.g., and) chemicals.

Kabat numbering: The terms "Kabat numbering", "Kabat definitions and "Kabat labeling" are used interchangeably herein. These terms, which are recognized in the art, refer to a system of numbering amino acid residues which are more variable (i.e. hypervariable) than other amino acid residues in the heavy and light chain variable regions of an antibody, or an antigen binding portion thereof (Kabat et al. (1971) Ann. NY Acad, Sci. 190:382-391 and, Kabat, E. A., et al. (1991) Sequences of Proteins of Immunological Interest, Fifth Edition, U.S. Department of Health and Human Services, NIH Publication No. 91-3242). For the heavy chain variable region, the hypervariable region ranges from amino acid positions 31 to 35 for CDR1, amino acid positions 50 to 65 for CDR2, and amino acid positions 95 to 102 for CDR3. For the light chain variable region, the hypervariable region ranges from amino acid positions 24 to 34 for CDR1, amino acid positions 50 to 56 for CDR2, and amino acid positions 89 to 97 for CDR3.

Molecular payload: As used herein, the term "molecular payload" refers to a molecule or species that functions to modulate a biological outcome. In some embodiments, a molecular payload is linked to, or otherwise associated with a muscle-targeting agent. In some embodiments, the molecular payload is a small molecule, a protein, a peptide, a nucleic acid, or an oligonucleotide. In some embodiments, the molecular payload functions to modulate the transcription of a DNA sequence, to modulate the expression of a protein, or to modulate the activity of a protein. In some embodiments, the molecular payload is an oligonucleotide that comprises a strand having a region of complementarity to a target gene.

Muscle-targeting agent: As used herein, the term, "muscle-targeting agent," refers to a molecule that specifically binds to an antigen expressed on muscle cells. The antigen in or on muscle cells may be a membrane protein, for example an integral membrane protein or a peripheral membrane protein. Typically, a muscle-targeting agent specifically binds to an antigen on muscle cells that facilitates internalization of the muscle-targeting agent (and any associated molecular payload) into the muscle cells. In some embodiments, a muscle-targeting agent specifically binds to an internalizing, cell surface receptor on muscles and is capable of being internalized into muscle cells through receptor mediated internalization. In some embodiments, the muscle-targeting agent is a small molecule, a protein, a peptide, a nucleic acid (e.g., an aptamer), or an antibody. In some embodiments, the muscle-targeting agent is linked to a molecular payload.

Muscle-targeting antibody: As used herein, the term, "muscle-targeting antibody," refers to a muscle-targeting agent that is an antibody that specifically binds to an antigen found in or on muscle cells. In some embodiments, a muscle-targeting antibody specifically binds to an antigen on muscle cells that facilitates internalization of the muscle-targeting antibody (and any associated molecular payment) into the muscle cells. In some embodiments, the muscle-targeting antibody specifically binds to an internalizing, cell surface receptor present on muscle cells. In some embodiments, the muscle-targeting antibody is an antibody that specifically binds to a transferrin receptor.

Oligonucleotide: As used herein, the term "oligonucleotide" refers to an oligomeric nucleic acid compound of up to 200 nucleotides in length. Examples of oligonucleotides include, but are not limited to, RNAi oligonucleotides (e.g., siRNAs, shRNAs), microRNAs, gapmers, mixmers, phosphorodiamidate morpholinos, peptide nucleic acids, aptamers, guide nucleic acids (e.g., Cas9 guide RNAs), etc. Oligonucleotides may be single-stranded or double-stranded. In some embodiments, an oligonucleotide may comprise one or more modified nucleotides (e.g. 2'-O-methyl sugar modifications, purine or pyrimidine modifications). In some embodiments, an oligonucleotide may comprise one or more modified internucleotide linkage. In some embodiments, an oligonucleotide may comprise one or more phosphorothioate linkages, which may be in the Rp or Sp stereochemical conformation.

Recombinant antibody: The term "recombinant human antibody", as used herein, is intended to include all human antibodies that are prepared, expressed, created or isolated by recombinant means, such as antibodies expressed using a recombinant expression vector transfected into a host cell (described in more details in this disclosure), antibodies isolated from a recombinant, combinatorial human antibody library (Hoogenboom H. R., (1997) TIB Tech. 15:62-70; Azzazy H., and Highsmith W. E., (2002) Clin. Biochem. 35:425-445; Gavilondo J. V., and Larrick J. W. (2002) Bio Techniques 29:128-145; Hoogenboom H., and Chames P. (2000) Immunology Today 21:371-378), antibodies isolated from an animal (e.g., a mouse) that is transgenic for human immunoglobulin genes (see e.g., Taylor, L. D., et al. (1992) Nucl. Acids Res. 20:6287-6295; Kellermann S-A., and Green L. L. (2002) Current Opinion in Biotechnology 13:593-597; Little M. et al (2000) Immunology Today 21:364-370) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germline repertoire in vivo. One embodiment of the disclosure provides fully human antibodies capable of binding human transferrin receptor which can be generated using techniques well known in the art, such as, but not limited to, using human Ig phage libraries such as those disclosed in Jermutus et al., PCT publication No. WO 2005/007699 A2.

Region of complementarity: As used herein, the term "region of complementarity" refers to a nucleotide sequence, e.g., of a oligonucleotide, that is sufficiently complementary to a cognate nucleotide sequence, e.g., of a target nucleic acid, such that the two nucleotide sequences are capable of annealing to one another under physiological conditions (e.g., in a cell). In some embodiments, a region of complementarity is fully complementary to a cognate nucleotide sequence of target nucleic acid. However, in some embodiments, a region of complementarity is partially complementary to a cognate nucleotide sequence of target nucleic acid (e.g., at least 80%, 90%, 95% or 99% complementarity). In some embodiments, a region of complementarity contains 1, 2, 3, or 4 mismatches compared with a cognate nucleotide sequence of a target nucleic acid.

Specifically binds: As used herein, the term "specifically binds" refers to the ability of a molecule to bind to a binding partner with a degree of affinity or avidity that enables the molecule to be used to distinguish the binding partner from an appropriate control in a binding assay or other binding context. With respect to an antibody, the term, "specifically binds", refers to the ability of the antibody to bind to a specific antigen with a degree of affinity or avidity, compared with an appropriate reference antigen or antigens, that enables the antibody to be used to distinguish the specific antigen from others, e.g., to an extent that permits preferential targeting to certain cells, e.g., muscle cells, through binding to the antigen, as described herein. In some embodiments, an antibody specifically binds to a target if the antibody has a $K_D$ for binding the target of at least about $10^{-4}$ M, $10^{-5}$ M, $10^{-6}$ M, $10^{-7}$ M, $10^{-8}$ M, $10^{-9}$ M, $10^{-10}$ M, $10^{-11}$ M, $10^{-12}$ M, $10^{-13}$ M, or less. In some embodiments, an antibody specifically binds to the transferrin receptor, e.g., an epitope of the apical domain of transferrin receptor.

Subject: As used herein, the term "subject" refers to a mammal. In some embodiments, a subject is non-human primate, or rodent. In some embodiments, a subject is a human. In some embodiments, a subject is a patient, e.g., a human patient that has or is suspected of having a disease. In some embodiments, the subject is a human patient who has or is suspected of having a disease resulting from a mutated DMD gene sequence, e.g., a mutation in an exon of a DMD gene sequence. In some embodiments, a subject has a dystrophinopathy, e.g., Duchenne muscular dystrophy.

Transferrin receptor: As used herein, the term, "transferrin receptor" (also known as TFRC, CD71, p90, TFR, or TFR1) refers to an internalizing cell surface receptor that binds transferrin to facilitate iron uptake by endocytosis. In some embodiments, a transferrin receptor may be of human (NCBI Gene ID 7037), non-human primate (e.g., NCBI Gene ID 711568 or NCBI Gene ID 102136007), or rodent (e.g., NCBI Gene ID 22042) origin. In addition, multiple human transcript variants have been characterized that encoded different isoforms of the receptor (e.g., as annotated under GenBank RefSeq Accession Numbers: NP_001121620.1, NP_003225.2, NP_001300894.1, and NP_001300895.1).

2'-modified nucleoside: As used herein, the terms "2'-modified nucleoside" and "2'-modified ribonucleoside" are used interchangeably and refer to a nucleoside having a sugar moiety modified at the 2' position. In some embodiments, the 2'-modified nucleoside is a 2'-4' bicyclic nucleoside, where the 2' and 4' positions of the sugar are bridged (e.g., via a methylene, an ethylene, or a (S)-constrained ethyl bridge). In some embodiments, the 2'-modified nucleoside is a non-bicyclic 2'-modified nucleoside, e.g., where the 2' position of the sugar moiety is substituted. Non-limiting examples of 2'-modified nucleosides include: 2'-deoxy, 2'-fluoro (2'-F), 2'-O-methyl (2'-O-Me), 2'-O-methoxyethyl (2'-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), 2'-O—N-methylacetamido (2'-O-NMA), locked nucleic acid (LNA, methylene-bridged nucleic acid), ethylene-bridged nucleic acid (ENA), and (S)-constrained ethyl-bridged nucleic acid (cEt). In some embodiments, the 2'-modified nucleosides described herein are high-affinity modified nucleotides and oligonucleotides comprising the 2'-modified nucleotides have increased affinity to a target sequences, relative to an unmodified oligonucleotide. Examples of structures of 2'-modified nucleosides are provided below:

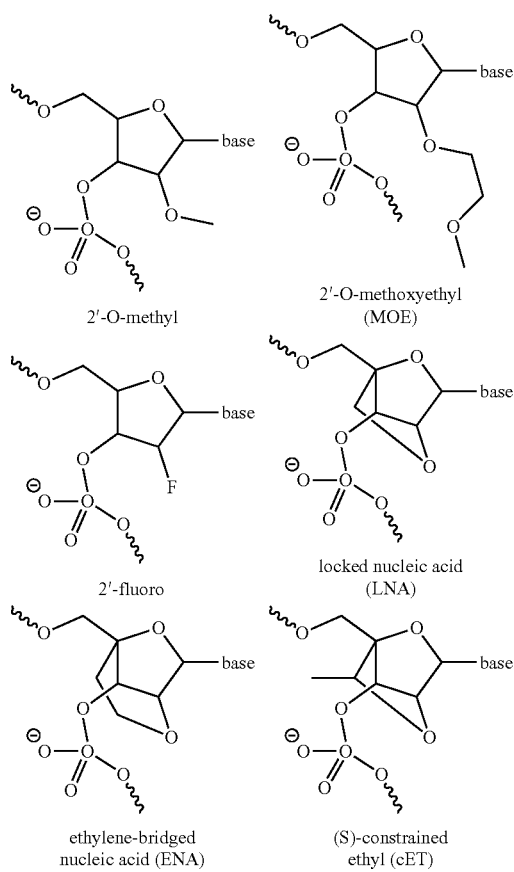

II. Complexes

Provided herein are complexes that comprise a targeting agent, e.g. an antibody, covalently linked to a molecular payload. In some embodiments, a complex comprises a muscle-targeting antibody covalently linked to an oligonucleotide. A complex may comprise an antibody that specifically binds a single antigenic site or that binds to at least two antigenic sites that may exist on the same or different antigens.

A complex may be used to modulate the activity or function of at least one gene, protein, and/or (e.g., and) nucleic acid. In some embodiments, the molecular payload present with a complex is responsible for the modulation of a gene, protein, and/or (e.g., and) nucleic acids. A molecular payload may be a small molecule, protein, nucleic acid, oligonucleotide, or any molecular entity capable of modulating the activity or function of a gene, protein, and/or (e.g., and) nucleic acid in a cell. In some embodiments, a molecular payload is an oligonucleotide that targets a disease-associated repeat in muscle cells.

In some embodiments, a complex comprises a muscle-targeting agent, e.g. an anti-transferrin receptor antibody, covalently linked to a molecular payload, e.g. a mixmer antisense oligonucleotide that targets a mutated DMD allele to promote exon skipping.

A. Muscle-Targeting Agents

Some aspects of the disclosure provide muscle-targeting agents, e.g., for delivering a molecular payload to a muscle cell. In some embodiments, such muscle-targeting agents are capable of binding to a muscle cell, e.g., via specifically binding to an antigen on the muscle cell, and delivering an associated molecular payload to the muscle cell. In some embodiments, the molecular payload is bound (e.g., covalently bound) to the muscle targeting agent and is internalized into the muscle cell upon binding of the muscle targeting agent to an antigen on the muscle cell, e.g., via endocytosis. It should be appreciated that various types of muscle-targeting agents may be used in accordance with the disclosure. For example, the muscle-targeting agent may comprise, or consist of, a nucleic acid (e.g., DNA or RNA), a peptide (e.g., an antibody), a lipid (e.g., a microvesicle), or a sugar moiety (e.g., a polysaccharide). Exemplary muscle-targeting agents are described in further detail herein, however, it should be appreciated that the exemplary muscle-targeting agents provided herein are not meant to be limiting.

Some aspects of the disclosure provide muscle-targeting agents that specifically bind to an antigen on muscle, such as skeletal muscle, smooth muscle, or cardiac muscle. In some embodiments, any of the muscle-targeting agents provided herein bind to (e.g., specifically bind to) an antigen on a skeletal muscle cell, a smooth muscle cell, and/or (e.g., and) a cardiac muscle cell.

By interacting with muscle-specific cell surface recognition elements (e.g., cell membrane proteins), both tissue localization and selective uptake into muscle cells can be achieved. In some embodiments, molecules that are substrates for muscle uptake transporters are useful for delivering a molecular payload into muscle tissue. Binding to muscle surface recognition elements followed by endocytosis can allow even large molecules such as antibodies to enter muscle cells. As another example molecular payloads conjugated to transferrin or anti-transferrin receptor antibodies can be taken up by muscle cells via binding to transferrin receptor, which may then be endocytosed, e.g., via clathrin-mediated endocytosis.

The use of muscle-targeting agents may be useful for concentrating a molecular payload (e.g., oligonucleotide) in muscle while reducing toxicity associated with effects in other tissues. In some embodiments, the muscle-targeting agent concentrates a bound molecular payload in muscle cells as compared to another cell type within a subject. In some embodiments, the muscle-targeting agent concentrates a bound molecular payload in muscle cells (e.g., skeletal, smooth, or cardiac muscle cells) in an amount that is at least 1, 2, 3, 4, 5, 6, 7, 8, 9, 10, 15, 20, 30, 40, 50, 60, 70, 80, 90, or 100 times greater than an amount in non-muscle cells (e.g., liver, neuronal, blood, or fat cells). In some embodiments, a toxicity of the molecular payload in a subject is reduced by at least 1%, 2%, 3%, 4%, 5%, 10%, 15%, 20%, 25%, 30%, 35%, 40%, 45%, 50%, 55%, 60%, 65%, 70%, 75%, 80%, 90%, or 95% when it is delivered to the subject when bound to the muscle-targeting agent.

In some embodiments, to achieve muscle selectivity, a muscle recognition element (e.g., a muscle cell antigen) may be required. As one example, a muscle-targeting agent may be a small molecule that is a substrate for a muscle-specific uptake transporter. As another example, a muscle-targeting agent may be an antibody that enters a muscle cell via transporter-mediated endocytosis. As another example, a muscle targeting agent may be a ligand that binds to cell surface receptor on a muscle cell. It should be appreciated that while transporter-based approaches provide a direct path for cellular entry, receptor-based targeting may involve stimulated endocytosis to reach the desired site of action.

i. Muscle-Targeting Antibodies

In some embodiments, the muscle-targeting agent is an antibody. Generally, the high specificity of antibodies for their target antigen provides the potential for selectively targeting muscle cells (e.g., skeletal, smooth, and/or (e.g., and) cardiac muscle cells). This specificity may also limit off-target toxicity. Examples of antibodies that are capable of targeting a surface antigen of muscle cells have been reported and are within the scope of the disclosure. For example, antibodies that target the surface of muscle cells are described in Arahata K., et al. "Immunostaining of skeletal and cardiac muscle surface membrane with antibody against Duchenne muscular dystrophy peptide" *Nature* 1988; 333:861-3; Song K. S., ct al. "Expression of caveolin-3 in skeletal, cardiac, and smooth muscle cells. Cavcolin-3 is a component of the sarcolemma and co-fractionates with dystrophin and dystrophin-associated glycoproteins" *J Biol Chem* 1996; 271:15160-5; and Weisbart R. H. et al., "Cell type specific targeted intracellular delivery into muscle of a monoclonal antibody that binds myosin IIb" *Mol Immunol.* 2003 March, 39 (13): 78309; the entire contents of each of which are incorporated herein by reference.

a. Anti-Transferrin Receptor Antibodies

Some aspects of the disclosure are based on the recognition that agents binding to transferrin receptor, e.g., anti-transferrin-receptor antibodies, are capable of targeting muscle cell. Transferrin receptors are internalizing cell surface receptors that transport transferrin across the cellular membrane and participate in the regulation and homeostasis of intracellular iron levels. Some aspects of the disclosure provide transferrin receptor binding proteins, which are capable of binding to transferrin receptor. Accordingly, aspects of the disclosure provide binding proteins (e.g., antibodies) that bind to transferrin receptor. In some embodiments, binding proteins that bind to transferrin receptor are internalized, along with any bound molecular payload, into a muscle cell. As used herein, an antibody that binds to a transferrin receptor may be referred to interchangeably as an, transferrin receptor antibody, an anti-transferrin receptor antibody, or an anti-TfR antibody. Antibodies that bind, e.g. specifically bind, to a transferrin receptor may be internalized into the cell, e.g. through receptor-mediated endocytosis, upon binding to a transferrin receptor.

It should be appreciated that anti-transferrin receptor antibodies may be produced, synthesized, and/or (e.g., and) derivatized using several known methodologies, e.g. library design using phage display. Exemplary methodologies have been characterized in the art and are incorporated by reference (Díez, P. et al. "High-throughput phage-display screening in array format", Enzyme and microbial technology, 2015, 79, 34-41.; Christoph M. H. and Stanley, J. R. "Antibody Phage Display: Technique and Applications" J Invest Dermatol. 2014, 134:2.; Engleman, Edgar (Ed.) "Human Hybridomas and Monoclonal Antibodies." 1985, Springer.). In other embodiments, an anti-transferrin antibody has been previously characterized or disclosed. Antibodies that specifically bind to transferrin receptor are known in the art (see, e.g. U.S. Pat. No. 4,364,934, filed Dec. 4, 1979, "Monoclonal antibody to a human early thymocyte antigen and methods for preparing same"; U.S. Pat. No. 8,409,573, filed Jun. 14, 2006, "Anti-CD71 monoclonal antibodies and uses thereof for treating malignant tumor cells"; U.S. Pat. No. 9,708,406, filed May 20, 2014, "Anti-transferrin receptor antibodies and methods of use"; U.S. Pat. No. 9,611,323, filed Dec. 19, 2014, "Low affinity blood brain barrier receptor antibodies and uses therefor"; WO 2015/098989, filed Dec. 24, 2014, "Novel anti-Transferrin receptor antibody that passes through blood-brain barrier"; Schneider C. et al. "Structural features of the cell surface receptor for transferrin that is recognized by the monoclonal antibody OKT9." J Biol Chem. 1982, 257:14, 8516-8522.; Lee et al. "Targeting Rat Anti-Mouse Transferrin Receptor Monoclonal Antibodies through Blood-Brain Barrier in Mouse" 2000, J Pharmacol. Exp. Ther., 292:1048-1052.).

Provided herein, in some aspects, are new anti-TfR antibodies for use as the muscle targeting agents (e.g., in muscle targeting complexes). In some embodiments, the anti-TfR antibody described herein binds to transferrin receptor with high specificity and affinity. In some embodiments, the anti-TfR antibody described herein specifically binds to any extracellular epitope of a transferrin receptor or an epitope that becomes exposed to an antibody. In some embodiments, anti-TfR antibodies provided herein bind specifically to transferrin receptor from human, non-human primates, mouse, rat, etc. In some embodiments, anti-TfR antibodies provided herein bind to human transferrin receptor. In some embodiments, the anti-TfR antibody described herein binds to an amino acid segment of a human or non-human primate transferrin receptor, as provided in SEQ ID NOs: 105-108. In some embodiments, the anti-TfR antibody described herein binds to an amino acid segment corresponding to amino acids 90-96 of a human transferrin receptor as set forth in SEQ ID NO: 105, which is not in the apical domain of the transferrin receptor.

An example human transferrin receptor amino acid sequence, corresponding to NCBI sequence NP_003225.2 (transferrin receptor protein 1 isoform 1, *Homo sapiens*) is as follows:

```
                                                (SEQ ID NO: 105)
MMDQARSAFSNLFGGEPLSYTRFSLARQVDGDNSHVEMKLAVDEEENADN

NTKANVTKPKRCSGSICYGTIAVIVFFLIGFMIGYLGYCKGVEPKTECER

LAGTESPVREEPGEDFPAARRLYWDDLKRKLSEKLDSTDFTGTIKLLNEN

SYVPREAGSQKDENLALYVENQFREFKLSKVWRDQHFVKIQVKDSAQNSV

IIVDKNGRLVYLVENPGGYVAYSKAATVTGKLVHANFGTKKDFEDLYTPV

NGSIVIVRAGKITFAEKVANAESLNAIGVLIYMDQTKFPIVNAELSFFGH

AHLGTGDPYTPGFPSFNHTQFPPSRSSGLPNIPVQTISRAAAEKLFGNME

GDCPSDWKTDSTCRMVTSESKNVKLTVSNVLKEIKILNIFGVIKGFVEPD
```

-continued
HYVVVGAQRDAWGPGAAKSGVGTALLLKLAQMFSDMVLKDGFQPSRSIIF

ASWSAGDFGSVGATEWLEGYLSSLHLKAFTYINLDKAVLGTSNFKVSASP

LLYTLIEKTMQNVKHPVTGQFLYQDSNWASKVEKLTLDNAAFPFLAYSGI

PAVSFCFCEDTDYPYLGTTMDTYKELIERIPELNKVARAAAEVAGQFVIK

LTHDVELNLDYERYNSQLLSFVRDLNQYRADIKEMGLSLQWLYSARGDFF

RATSRLTTDFGNAEKTDRFVMKKLNDRVMRVEYHFLSPYVSPKESPFRHV

FWGSGSHTLPALLENLKLRKQNNGAFNETLFRNQLALATWTIQGAANALS

GDVWDIDNEF.

An example non-human primate transferrin receptor amino acid sequence, corresponding to NCBI sequence NP_001244232.1 (transferrin receptor protein 1, *Macaca mulatta*) is as follows:

(SEQ ID NO: 106)
MMDQARSAFSNLFGGEPLSYTRFSLARQVDGDNSHVEMKLGVDEEENTDN

NTKPNGTKPKRCGGNICYGTIAVIIFFLIGFMIGYLGYCKGVEPKTECER

LAGTESPAREEPEEDFPAAPRLYWDDLKRKLSEKLDTTDFTSTIKLLNEN

LYVPREAGSQKDENLALYIENQFREFKLSKVWRDQHFVKIQVKDSAQNSV

IIVDKNGGLVYLVENPGGYVAYSKAATVTGKLVHANFGTKKDFEDLDSPV

NGSIVIVRAGKITFAEKVANAESLNAIGVLIYMDQTKFPIVKADLSFFGH

AHLGTGDPYTPGFPSFNHTQFPPSQSSGLPNIPVQTISRAAAEKLFGNME

GDCPSDWKTDSTCKMVTSENKSVKLTVSNVLKETKILNIFGVIKGFVEPD

HYVVVGAQRDAWGPGAAKSSVGTALLLKLAQMFSDMVLKDGFQPSRSIIF

ASWSAGDFGSVGATEWLEGYLSSLHLKAFTYINLDKAVLGTSNFKVSASP

LLYTLIEKTMQDVKHPVTGRSLYQDSNWASKVEKLTLDNAAFPFLAYSGI

PAVSFCFCEDTDYPYLGTTMDTYKELVERIPELNKVARAAAEVAGQFVIK

LTHDTELNLDYERYNSQLLLFLRDLNQYRADVKEMGLSLQWLYSARGDFF

RATSRLTTDFRNAEKRDKFVMKKLNDRVMRVEYYFLSPYVSPKESPFRHV

FWGSGSHTLSALLESLKLRRQNNSAFNETLFRNQLALATWTIQGAANALS

GDVWDIDNEF

An example non-human primate transferrin receptor amino acid sequence, corresponding to NCBI sequence XP_005545315.1 (transferrin receptor protein 1, *Macaca fascicularis*) is as follows:

(SEQ ID NO: 107)
MMDQARSAFSNLFGGEPLSYTRFSLARQVDGDNSHVEMKLGVDEEENTDN

NTKANGTKPKRCGGNICYGTIAVIIFFLIGFMIGYLGYCKGVEPKTECER

LAGTESPAREEPEEDFPAAPRLYWDDLKRKLSEKLDTTDFTSTIKLLNEN

LYVPREAGSQKDENLALYIENQFREFKLSKVWRDQHFVKIQVKDSAQNSV

IIVDKNGGLVYLVENPGGYVAYSKAATVTGKLVHANFGTKKDFEDLDSPV

NGSIVIVRAGKITFAEKVANAESLNAIGVLIYMDQTKFPIVKADLSFFGH

AHLGTGDPYTPGFPSFNHTQFPPSQSSGLPNIPVQTISRAAAEKLFGNME

GDCPSDWKTDSTCKMVTSENKSVKLTVSNVLKETKILNIFGVIKGFVEPD

HYVVVGAQRDAWGPGAAKSSVGTALLLKLAQMESDMVLKDGFQPSRSIIF

ASWSAGDFGSVGATEWLEGYLSSLHLKAFTYINLDKAVLGTSNFKVSASP

LLYTLIEKTMQDVKHPVTGRSLYQDSNWASKVEKLTLDNAAFPFLAYSGI

PAVSFCFCEDTDYPYLGTTMDTYKELVERIPELNKVARAAAEVAGQFVIK

LTHDTELNLDYERYNSQLLLFLRDLNQYRADVKEMGLSLQWLYSARGDFF

RATSRLTTDFRNAEKRDKFVMKKLNDRVMRVEYYFLSPYVSPKESPFRHV

FWGSGSHTLSALLESLKLRRQNNSAFNETLFRNQLALATWTIQGAANALS

GDVWDIDNEF.

An example mouse transferrin receptor amino acid sequence, corresponding to NCBI sequence NP_001344227.1 (transferrin receptor protein 1, *Mus musculus*) is as follows:

(SEQ ID NO: 108)
MMDQARSAFSNLFGGEPLSYTRFSLARQVDGDNSHVEMKLAADEEENADN

NMKASVRKPKRFNGRLCFAAIALVIFFLIGFMSGYLGYCKRVEQKEECVK

LAETEETDKSETMETEDVPTSSRLYWADLKTLLSEKLNSIEFADTIKQLS

QNTYTPREAGSQKDESLAYYIENQFHEFKFSKVWRDEHYVKIQVKSSIGQ

NMVTIVQSNGNLDPVESPEGYVAFSKPTEVSGKLVHANFGTKKDFEELSY

SVNGSLVIVRAGEITFAEKVANAQSFNAIGVLIYMDKNKFPVVEADLALF

GHAHLGTGDPYTPGFPSFNHTQFPPSQSSGLPNIPVQTISRAAAEKLFGK

MEGSCPARWNIDSSCKLELSQNQNVKLIVKNVLKERRILNIFGVIKGYEE

PDRYVVVGAQRDALGAGVAAKSSVGTGLLLKLAQVFSDMISKDGFRPSRS

IIFASWTAGDFGAVGATEWLEGYLSSLHLKAFTYINLDKVVLGTSNFKVS

ASPLLYTLMGKIMQDVKHPVDGKSLYRDSNWISKVEKLSFDNAAYPFLAY

SGIPAVSFCFCEDADYPYLGTRLDTYEALTQKVPQLNQMVRTAAEVAGQL

IIKLTHDVELNLDYEMYNSKLLSFMKDLNQFKTDIRDMGLSLQWLYSARG

DYFRATSRLTTDFHNAEKTNRFVMREINDRIMKVEYHFLSPYVSPRESPF

RHIFWGSGSHTLSALVENLKLRQKNITAFNETLFRNQLALATWTIQGVAN

ALSGDIWNIDNEF

In some embodiments, an anti-transferrin receptor antibody binds to an amino acid segment of the receptor as follows: FVKIQVKDSAQNSVIIVDKNGRLVYLVENPG-GYVAYSKAATVTGKLVHANFGTKKDF EDLYTPVNG-SIVIVRAGKITFAEKVANAESLN-AIGVLIYMDQTKFPIVNAELSFFGHAH LGTGDPYTPGFPSFNHTQFPPSRSSGLPNIPVQTIS-RAAAEKLFGNMEGDCPSDWKTDS TCRMVTS-ESKNVKLTVSNVLKE (SEQ ID NO: 109) and does not inhibit the binding interactions between transferrin receptors and transferrin and/or (e.g., and) human hemochromatosis protein (also known as HFE). In some embodiments, the anti-transferrin receptor antibody described herein does not bind an epitope in SEQ ID NO: 109.

Appropriate methodologies may be used to obtain and/or (e.g., and) produce antibodies, antibody fragments, or antigen-binding agents, e.g., through the use of recombinant DNA protocols. In some embodiments, an antibody may also be produced through the generation of hybridomas (see, e.g., Kohler, G and Milstein, C. "Continuous cultures of fused cells secreting antibody of predefined specificity"

Nature, 1975, 256:495-497). The antigen-of-interest may be used as the immunogen in any form or entity, e.g., recombinant or a naturally occurring form or entity. Hybridomas are screened using standard methods, e.g. ELISA screening, to find at least one hybridoma that produces an antibody that targets a particular antigen. Antibodies may also be produced through screening of protein expression libraries that express antibodies, e.g., phage display libraries. Phage display library design may also be used, in some embodiments, (see, e.g. U.S. Pat. No. 5,223,409, filed Mar. 1, 1991, "Directed evolution of novel binding proteins"; WO 1992/18619, filed Apr. 10, 1992, "Heterodimeric receptor libraries using phagemids"; WO 1991/17271, filed May 1, 1991, "Recombinant library screening methods"; WO 1992/20791, filed May 15, 1992, "Methods for producing members of specific binding pairs"; WO 1992/15679, filed Feb. 28, 1992, and "Improved epitope displaying phage"). In some embodiments, an antigen-of-interest may be used to immunize a non-human animal, e.g., a rodent or a goat. In some embodiments, an antibody is then obtained from the non-human animal, and may be optionally modified using a number of methodologies, e.g., using recombinant DNA techniques. Additional examples of antibody production and methodologies are known in the art (see, e.g. Harlow et al. "Antibodies: A Laboratory Manual", Cold Spring Harbor Laboratory, 1988.).

In some embodiments, an antibody is modified, e.g., modified via glycosylation, phosphorylation, sumoylation, and/or (e.g., and) methylation. In some embodiments, an antibody is a glycosylated antibody, which is conjugated to one or more sugar or carbohydrate molecules. In some embodiments, the one or more sugar or carbohydrate molecule are conjugated to the antibody via N-glycosylation, O-glycosylation, C-glycosylation, glypiation (GPI anchor attachment), and/or (e.g., and) phosphoglycosylation. In some embodiments, the one or more sugar or carbohydrate molecules are monosaccharides, disaccharides, oligosaccharides, or glycans. In some embodiments, the one or more sugar or carbohydrate molecule is a branched oligosaccharide or a branched glycan. In some embodiments, the one or more sugar or carbohydrate molecule includes a mannose unit, a glucose unit, an N-acetylglucosamine unit, an N-acetylgalactosamine unit, a galactose unit, a fucose unit, or a phospholipid unit. In some embodiments, there are about 1-10, about 1-5, about 5-10, about 1-4, about 1-3, or about 2 sugar molecules. In some embodiments, a glycosylated antibody is fully or partially glycosylated. In some embodiments, an antibody is glycosylated by chemical reactions or by enzymatic means. In some embodiments, an antibody is glycosylated in vitro or inside a cell, which may optionally be deficient in an enzyme in the N- or O-glycosylation pathway, e.g. a glycosyltransferase. In some embodiments, an antibody is functionalized with sugar or carbohydrate molecules as described in International Patent Application Publication WO2014065661, published on May 1, 2014, entitled, *"Modified antibody, antibody-conjugate and process for the preparation thereof"*.

In some embodiments, the anti-TfR antibody of the present disclosure comprises a VL domain and/or (e.g., and) VH domain of any one of the anti-TfR antibodies selected from Table 2, and comprises a constant region comprising the amino acid sequences of the constant regions of an IgG, IgE, IgM, IgD, IgA or IgY immunoglobulin molecule, any class (e.g., IgG1, IgG2, IgG3, IgG4, IgA1 and IgA2), or any subclass (e.g., IgG2a and IgG2b) of immunoglobulin molecule. Non-limiting examples of human constant regions are described in the art, e.g., see Kabat E A et al., (1991) supra.

In some embodiments, agents binding to transferrin receptor, e.g., anti-TfR antibodies, are capable of targeting muscle cell and/or (e.g., and) mediate the transportation of an agent across the blood brain barrier. Transferrin receptors are internalizing cell surface receptors that transport transferrin across the cellular membrane and participate in the regulation and homeostasis of intracellular iron levels. Some aspects of the disclosure provide transferrin receptor binding proteins, which are capable of binding to transferrin receptor. Antibodies that bind, e.g. specifically bind, to a transferrin receptor may be internalized into the cell, e.g. through receptor-mediated endocytosis, upon binding to a transferrin receptor.

Provided herein, in some aspects, are humanized antibodies that bind to transferrin receptor with high specificity and affinity. In some embodiments, the humanized anti-TfR antibody described herein specifically binds to any extracellular epitope of a transferrin receptor or an epitope that becomes exposed to an antibody. In some embodiments, the humanized anti-TfR antibodies provided herein bind specifically to transferrin receptor from human, non-human primates, mouse, rat, etc. In some embodiments, the humanized anti-TfR antibodies provided herein bind to human transferrin receptor. In some embodiments, the humanized anti-TfR antibody described herein binds to an amino acid segment of a human or non-human primate transferrin receptor, as provided in SEQ ID NOs: 105-108. In some embodiments, the humanized anti-TfR antibody described herein binds to an amino acid segment corresponding to amino acids 90-96 of a human transferrin receptor as set forth in SEQ ID NO: 105, which is not in the apical domain of the transferrin receptor. In some embodiments, the humanized anti-TfR antibodies described herein binds to TfR1 but does not bind to TR2.

In some embodiments, an anti-TFR antibody specifically binds a TfR1 (e.g., a human or non-human primate TfR1) with binding affinity (e.g., as indicated by Kd) of at least about $10^{-4}$ M, $10^{-5}$ M, $10^{-6}$ M, $10^{-7}$ M, $10^{-8}$ M, $10^{-9}$ M, $10^{-10}$ M, $10^{-11}$ M, $10^{-12}$ M, $10^{-13}$ M, or less. In some embodiments, the anti-TfR antibodies described herein binds to TfR1 with a KD of sub-nanomolar range. In some embodiments, the anti-TfR antibodies described herein selectively binds to transferrin receptor 1 (TfR1) but do not bind to transferrin receptor 2 (TfR2). In some embodiments, the anti-TfR antibodies described herein binds to human TfR1 and cyno TfR1 (e.g., with a Kd of $10^{-7}$ M, $10^{-8}$ M, $10^{-9}$ M, $10^{-10}$ M, $10^{-11}$ M, $10^{-12}$ M, $10^{-13}$ M, or less), but does not bind to a mouse TfR1. The affinity and binding kinetics of the anti-TfR antibody can be tested using any suitable method including but not limited to biosensor technology (e.g., OCTET or BIACORE). In some embodiments, binding of any one of the anti-TfR antibody described herein does not complete with or inhibit transferrin binding to the TfR1. In some embodiments, binding of any one of the anti-TfR antibody described herein does not complete with or inhibit HFE-beta-2-microglobulin binding to the TfR1.

The anti-TfR antibodies described herein are humanized antibodies. The CDR and variable region amino acid sequences of the mouse monoclonal anti-TfR antibody from which the humanized anti-TfR antibodies described herein are derived are provided in Table 2.

TABLE 2

Mouse Monoclonal Anti-TfR Antibodies

| Ab | No. system | IMGT | Kabat | Chothia |
|---|---|---|---|---|
| 3-A4 | CDR-H1 | GFNIKDDY (SEQ ID NO: 1) | DDYMY (SEQ ID NO: 7) | GFNIKDD (SEQ ID NO: 12) |
| | CDR-H2 | IDPENGDT (SEQ ID NO: 2) | WIDPENGDTEY ASKFQD (SEQ ID NO: 8) | ENG (SEQ ID NO: 13) |
| | CDR-H3 | TLWLRRGLDY (SEQ ID NO: 3) | WLRRGLDY (SEQ ID NO: 9) | LRRGLD (SEQ ID NO: 14) |
| | CDR-L1 | KSLLHSNGYTY (SEQ ID NO: 4) | RSSKSLLHSNGYTYLF (SEQ ID NO: 10) | SKSLLHSNGYTY (SEQ ID NO: 15) |
| | CDR-L2 | RMS (SEQ ID NO: 5) | RMSNLAS (SEQ ID NO: 11) | RMS (SEQ ID NO: 5) |
| | CDR-L3 | MQHLEYPFT (SEQ ID NO: 6) | MQHLEYPFT (SEQ ID NO: 6) | HLEYPF (SEQ ID NO: 16) |
| | VH | EVQLQQSGAELVRPGASVKLSCTASGFNIKDDYMYWVKQRPEQGLEWIGWIDPENGDTEY ASKFQDKATVTADTSSNTAYLQLSSLTSEDTAVYYCTLWLRRGLDYWGQGTSVTVSS (SEQ ID NO: 17) | | |
| | VL | DIVMTQAAPSVPVTPGESVSISCRSSKSLLHSNGYTYLFWFLQRPGQSPQLLIYRMSNLA SGVPDRFSGSGSGTAFTLRISRVEAEDVGVYYCMQHLEYPFTFGGGTKLEIK (SEQ ID NO: 18) | | |
| 3-A4 N54T* | CDR-H1 | GFNIKDDY (SEQ ID NO: 1) | DDYMY (SEQ ID NO: 7) | GFNIKDD (SEQ ID NO: 12) |
| | CDR-H2 | IDPETGDT (SEQ ID NO: 19) | WIDPETGDTEYASKFQD (SEQ ID NO: 20) | ETG (SEQ ID NO: 21) |
| | CDR-H3 | TLWLRRGLDY (SEQ ID NO: 3) | WLRRGLDY (SEQ ID NO: 9) | LRRGLD (SEQ ID NO: 14) |
| | CDR-L1 | KSLLHSNGYTY (SEQ ID NO: 4) | RSSKSLLHSNGYTYLF (SEQ ID NO: 10) | SKSLLHSNGYTY (SEQ ID NO: 15) |
| | CDR-L2 | RMS (SEQ ID NO: 5) | RMSNLAS (SEQ ID NO: 11) | RMS (SEQ ID NO: 5) |
| | CDR-L3 | MQHLEYPFT (SEQ ID NO: 6) | MQHLEYPFT (SEQ ID NO: 6) | HLEYPF (SEQ ID NO: 16) |
| | VH | EVQLQQSGAELVRPGASVKLSCTASGFNIKDDYMYWVKQRPEQGLEWIGWIDPETGDTEY ASKFQDKATVTADTSSNTAYLQLSSLTSEDTAVYYCTLWLRRGLDYWGQGTSVTVSS (SEQ ID NO: 22) | | |
| | VL | DIVMTQAAPSVPVTPGESVSISCRSSKSLLHSNGYTYLFWFLQRPGQSPQLLIYRMSNLA SGVPDRFSGSGSGTAFTLRISRVEAEDVGVYYCMQHLEYPFTFGGGTKLEIK (SEQ ID NO: 18) | | |
| 3-A4 N54S* | CDR-H1 | GFNIKDDY (SEQ ID NO: 1) | DDYMY (SEQ ID NO: 7) | GFNIKDD (SEQ ID NO: 12) |
| | CDR-H2 | IDPESGDT (SEQ ID NO: 23) | WIDPESGDTEYASKFQD (SEQ ID NO: 24) | ESG (SEQ ID NO: 25) |
| | CDR-H3 | TLWLRRGLDY (SEQ ID NO: 3) | WLRRGLDY (SEQ ID NO: 9) | LRRGLD (SEQ ID NO: 14) |
| | CDR-L1 | KSLLHSNGYTY (SEQ ID NO: 4) | RSSKSLLHSNGYTYLF (SEQ ID NO: 10) | SKSLLHSNGYTY (SEQ ID NO: 15) |
| | CDR-L2 | RMS (SEQ ID NO: 5) | RMSNLAS (SEQ ID NO: 11) | RMS (SEQ ID NO: 5) |
| | CDR-L3 | MQHLEYPFT (SEQ ID NO: 6) | MQHLEYPFT (SEQ ID NO: 6) | HLEYPF (SEQ ID NO: 16) |
| | VH | EVQLQQSGAELVRPGASVKLSCTASGFNIKDDYMYWVKQRPEQGLEWIGWIDPESGDTEY ASKFQDKATVTADTSSNTAYLQLSSLTSEDTAVYYCTLWLRRGLDYWGQGTSVTVSS (SEQ ID NO: 26) | | |
| | VL | DIVMTQAAPSVPVTPGESVSISCRSSKSLLHSNGYTYLFWFLQRPGQSPQLLIYRMSNLA SGVPDRFSGSGSGTAFTLRISRVEAEDVGVYYCMQHLEYPFTFGGGTKLEIK (SEQ ID NO: 18) | | |
| 3-M12 | CDR-H1 | GYSITSGYY (SEQ ID NO: 27) | SGYYWN (SEQ ID NO: 33) | GYSITSGY (SEQ ID NO: 38) |
| | CDR-H2 | ITFDGAN (SEQ ID NO: 28) | YITFDGANNYNPSLKN (SEQ ID NO: 34) | FDG (SEQ ID NO: 39) |
| | CDR-H3 | TRSSYDYDVLDY (SEQ ID NO: 29) | SSYDYDVLDY (SEQ ID NO: 35) | SYDYDVLD (SEQ ID NO: 40) |
| | CDR-L1 | QDISNF (SEQ ID NO: 30) | RASQDISNFLN (SEQ ID NO: 36) | SQDISNF (SEQ ID NO: 41) |
| | CDR-L2 | YTS (SEQ ID NO: 31) | YTSRLHS (SEQ ID NO: 37) | YTS (SEQ ID NO: 31) |
| | CDR-L3 | QQGHTLPYT (SEQ ID NO: 32) | QQGHTLPYT (SEQ ID NO: 32) | GHTLPY (SEQ ID NO: 42) |
| | VH | DVQLQESGPGLVKPSQSLSLTCSVTGYSITSGYYWNWIRQFPGNKLEWMGYITFDGANNY NPSLKNRISITRDTSKNQFFLKLTSVTTEDTATYYCTRSSYDYDVLDYWGQGTTLTVSS (SEQ ID NO: 43) | | |
| | VL | DIQMTQTTSSLSASLGDRVTISCRASQDISNFLNWYQQRPDGTVKLLIYYTSRLHSGVPS RFSGSGSGTDFSLTVSNLEQEDIATYFCQQGHTLPYTFGGGTKLEIK (SEQ ID NO: 44) | | |

TABLE 2-continued

Mouse Monoclonal Anti-TfR Antibodies

| Ab | No. system | IMGT | Kabat | Chothia |
|---|---|---|---|---|
| 5-H12 | CDR-H1 | GYSFTDYC (SEQ ID NO: 45) | DYCIN (SEQ ID NO: 51) | GYSFTDY (SEQ ID NO: 56) |
| | CDR-H2 | IYPGSGNT (SEQ ID NO: 46) | WIYPGSGNTRYSERFKG (SEQ ID NO: 52) | GSG (SEQ ID NO: 57) |
| | CDR-H3 | AREDYYPYHGMDY (SEQ ID NO: 47) | EDYYPYHGMDY (SEQ ID NO: 53) | DYYPYHGMD (SEQ ID NO: 58) |
| | CDR-L1 | ESVDGYDNSF (SEQ ID NO: 48) | RASESVDGYDNSFMH (SEQ ID NO: 54) | SESVDGYDNSF (SEQ ID NO: 59) |
| | CDR-L2 | RAS (SEQ ID NO: 49) | RASNLES (SEQ ID NO: 55) | RAS (SEQ ID NO: 49) |
| | CDR-L3 | QQSSEDPWT (SEQ ID NO: 50) | QQSSEDPWT (SEQ ID NO: 50) | SSEDPW (SEQ ID NO: 60) |
| | VH | QIQLQQSGPELVRPGASVKISCKASGYSFTDYCINWVNQRPGQGLEWIGWIYPGSGNTRYSERFKGKATLTVDTSSNTAYMQLSSLTSEDSAVYFCAREDYYPYHGMDYWGQGTSVTVSS (SEQ ID NO: 61) | | |
| | VL | DIVLTQSPTSLAVSLGQRATISCRASESVDGYDNSFMHWYQQKPGQPPKLLIFRASNLESGIPARFSGSGSRTDFTLTINPVEAADVATYYCQQSSEDPWTFGGGTKLEIK (SEQ ID NO: 62) | | |
| 5-H12 C33Y* | CDR-H1 | GYSFTDYY (SEQ ID NO: 63) | DYYIN (SEQ ID NO: 64) | GYSFTDY (SEQ ID NO: 56) |
| | CDR-H2 | IYPGSGNT (SEQ ID NO: 46) | WIYPGSGNTRYSERFKG (SEQ ID NO: 52) | GSG (SEQ ID NO: 57) |
| | CDR-H3 | AREDYYPYHGMDY (SEQ ID NO: 47) | EDYYPYHGMDY (SEQ ID NO: 53) | DYYPYHGMD (SEQ ID NO: 58) |
| | CDR-L1 | ESVDGYDNSF (SEQ ID NO: 48) | RASESVDGYDNSFMH (SEQ ID NO: 54) | SESVDGYDNSF (SEQ ID NO: 59) |
| | CDR-L2 | RAS (SEQ ID NO: 49) | RASNLES (SEQ ID NO: 55) | RAS (SEQ ID NO: 49) |
| | CDR-L3 | QQSSEDPWT (SEQ ID NO: 50) | QQSSEDPWT (SEQ ID NO: 50) | SSEDPW (SEQ ID NO: 60) |
| | VH | QIQLQQSGPELVRPGASVKISCKASGYSFTDYYINWVNQRPGQGLEWIGWIYPGSGNTRYSERFKGKATLTVDTSSNTAYMQLSSLTSEDSAVYFCAREDYYPYHGMDYWGQGTSVTVSS (SEQ ID NO: 65) | | |
| | VL | DIVLTQSPTSLAVSLGQRATISCRASESVDGYDNSFMHWYQQKPGQPPKLLIFRASNLESGIPARFSGSGSRTDFTLTINPVEAADVATYYCQQSSEDPWTFGGGTKLEIK (SEQ ID NO: 62) | | |
| 5-H12 C33D* | CDR-H1 | GYSFTDYD (SEQ ID NO: 66) | DYDIN (SEQ ID NO: 67) | GYSFTDY (SEQ ID NO: 56) |
| | CDR-H2 | IYPGSGNT (SEQ ID NO: 46) | WIYPGSGNTRYSERFKG (SEQ ID NO: 52) | GSG (SEQ ID NO: 57) |
| | CDR-H3 | AREDYYPYHGMDY (SEQ ID NO: 47) | EDYYPYHGMDY (SEQ ID NO: 53) | DYYPYHGMD (SEQ ID NO: 58) |
| | CDR-L1 | ESVDGYDNSF (SEQ ID NO: 48) | RASESVDGYDNSFMH (SEQ ID NO: 54) | SESVDGYDNSF (SEQ ID NO: 59) |
| | CDR-L2 | RAS (SEQ ID NO: 49) | RASNLES (SEQ ID NO: 55) | RAS (SEQ ID NO: 49) |
| | CDR-L3 | QQSSEDPWT (SEQ ID NO: 50) | QQSSEDPWT (SEQ ID NO: 50) | SSEDPW (SEQ ID NO: 60) |
| | VH | QIQLQQSGPELVRPGASVKISCKASGYSFTDYDINWVNQRPGQGLEWIGWIYPGSGNTRYSERFKGKATLTVDTSSNTAYMQLSSLTSEDSAVYFCAREDYYPYHGMDYWGQGTSVTVSS (SEQ ID NO: 68) | | |
| | VL | DIVLTQSPTSLAVSLGQRATISCRASESVDGYDNSFMHWYQQKPGQPPKLLIFRASNLESGIPARFSGSGSRTDFTLTINPVEAADVATYYCQQSSEDPWTFGGGTKLEIK (SEQ ID NO: 62) | | |

*mutation positions are according to Kabat numbering of the respective VH sequences containing the mutations In some embodiments, the anti-TfR antibody of the present disclosure is a humanized variant of any one of the anti-TfR antibodies provided in Table 2. In some embodiments, the anti-TfR antibody of the present disclosure comprises a CDR-H1, a CDR-H2, a CDR-H3, a CDR-L1, a CDR-L2, and a CDR-L3 that are the same as the CDR-H1, CDR-H2, and CDR-H3 in any one of the anti-TfR antibodies provided in Table 2, and comprises a humanized heavy chain variable region and/or (e.g., and) a humanized light chain variable region.

Humanized antibodies are human immunoglobulins (recipient antibody) in which residues from a complementarity determining region (CDR) of the recipient are replaced by residues from a CDR of a non-human species (donor antibody) such as mouse, rat, or rabbit having the desired specificity, affinity, and capacity. In some embodiments, Fv framework region (FR) residues of the human immunoglobulin are replaced by corresponding non-human residues. Furthermore, the humanized antibody may comprise residues that are found neither in the recipient antibody nor in the imported CDR or framework sequences, but are included to further refine and optimize antibody performance. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region or domain (Fc), typically that of a human immunoglobulin. Antibodies may have Fc regions modified as described in WO 99/58572. Other forms of humanized antibodies have one or more CDRs (one, two, three, four, five, six) which are altered with respect to the original antibody, which are also termed one or more CDRs derived from one or more CDRs from the original antibody. Humanized antibodies may also involve affinity maturation.

Humanized antibodies and methods of making them are known, e.g., as described in Almagro et al., Front. Biosci. 13:1619-1633 (2008); Riechmann et al., Nature 332:323-329 (1988); Queen et al., Proc. Nat'l Acad. Sci. USA 86:10029-10033 (1989); U.S. Pat. Nos. 5,821,337, 7,527,791, 6,982,321, and 7,087,409; Kashmiri et al., Methods 36:25-34 (2005); Padlan et al., Mol. Immunol. 28:489-498 (1991); Dall'Acqua et al., Methods 36:43-60 (2005); Osbourn et al., Methods 36:61-68 (2005); and Klimka et al., Br. J. Cancer, 83:252-260 (2000), the contents of all of which are incorporated herein by reference. Human framework regions that may be used for humanization are described in e.g., Sims et al. J. Immunol. 151:2296 (1993); Carter et al., Proc. Natl. Acad. Sci. USA, 89:4285 (1992); Presta et al., J. Immunol., 151:2623 (1993); Almagro et al., Front. Biosci. 13:1619-1633 (2008)); Baca et al., J. Biol. Chem. 272:10678-10684 (1997); and Rosok et al., J Biol. Chem. 271:22611-22618 (1996), the contents of all of which are incorporated herein by reference.

In some embodiments, the humanized anti-TfR antibody of the present disclosure comprises a humanized VH comprising one or more amino acid variations (e.g., in the VH framework region) as compared with any one of the VHs listed in Table 2, and/or (e.g., and) a humanized VL comprising one or more amino acid variations (e.g., in the VL framework region) as compared with any one of the VLs listed in Table 2.

In some embodiments, the humanized anti-TfR antibody of the present disclosure comprises a humanized VH containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VH of any of the anti-TfR antibodies listed in Table 2 (e.g., any one of SEQ ID NOs: 17, 22, 26, 43, 61, 65, and 68). Alternatively or in addition (e.g., in addition), the humanized anti-TfR antibody of the present disclosure comprises a humanized VL containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VL of any one of the anti-TfR antibodies listed in Table 2 (e.g., any one of SEQ ID NOs: 18, 44, and 62).

In some embodiments, the humanized anti-TfR antibody of the present disclosure comprises a humanized VH comprising an amino acid sequence that is at least 75% (e.g., 75%, 80%, 85%, 90%, 95%, 98%, or 99%) identical in the framework regions to the VH of any of the anti-TfR antibodies listed in Table 2 (e.g., any one of SEQ ID NOs: 17, 22, 26, 43, 61, 65, and 68). Alternatively or in addition (e.g., in addition), In some embodiments, the humanized anti-TfR antibody of the present disclosure comprises a humanized VL comprising an amino acid sequence that is at least 75% (e.g., 75%, 80%, 85%, 90%, 95%, 98%, or 99%) identical in the framework regions to the VL of any of the anti-TfR antibodies listed in Table 2 (e.g., any one of SEQ ID NOs: 18, 44, and 62).

In some embodiments, the humanized anti-TfR antibody of the present disclosure comprises a humanized VH comprising a CDR-H1 having the amino acid sequence of SEQ ID NO: 1 (according to the IMGT definition system), a CDR-H2 having the amino acid sequence of SEQ ID NO: 2, SEQ ID NO: 19, or SEQ ID NO: 23 (according to the IMGT definition system), a CDR-H3 having the amino acid sequence of SEQ ID NO: 3 (according to the IMGT definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VH as set forth in SEQ ID NO: 17, SEQ ID NO: 22, or SEQ ID NO: 26. Alternatively or in addition (e.g., in addition), the anti-TfR antibody of the present disclosure comprises a humanized VL comprising a CDR-L1 having the amino acid sequence of SEQ ID NO: 4 (according to the IMGT definition system), a CDR-L2 having the amino acid sequence of SEQ ID NO: 5 (according to the IMGT definition system), and a CDR-L3 having the amino acid sequence of SEQ ID NO: 6 (according to the IMGT definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VL as set forth in SEQ ID NO: 18.

In some embodiments, the humanized anti-TfR antibody of the present disclosure comprises a humanized VH comprising a CDR-H1 having the amino acid sequence of SEQ ID NO: 1 (according to the IMGT definition system), a CDR-H2 having the amino acid sequence of SEQ ID NO: 2, SEQ ID NO: 19, or SEQ ID NO: 23 (according to the IMGT definition system), a CDR-H3 having the amino acid sequence of SEQ ID NO: 3 (according to the IMGT definition system), and is at least 75% (e.g., 75%, 80%, 85%, 90%, 95%, 98%, or 99%) identical in the framework regions to the VH as set forth in SEQ ID NO: 17, SEQ ID NO: 22, or SEQ ID NO: 26. Alternatively or in addition (e.g., in addition), the humanized anti-TfR antibody of the present disclosure comprises a humanized VL comprising a CDR-L1 having the amino acid sequence of SEQ ID NO: 4 (according to the IMGT definition system), a CDR-L2 having the amino acid sequence of SEQ ID NO: 5 (according to the IMGT definition system), and a CDR-L3 having the amino acid sequence of SEQ ID NO: 6 (according to the IMGT definition system), and is at least 75% (e.g., 75%, 80%, 85%, 90%, 95%, 98%, or 99%) identical in the framework regions to the VL as set forth in any one of SEQ ID NO: 18.

In some embodiments, the humanized anti-TfR antibody of the present disclosure comprises a humanized VH comprising a CDR-H1 having the amino acid sequence of SEQ ID NO: 7 (according to the Kabat definition system), a CDR-H2 having the amino acid sequence of SEQ ID NO: 8, SEQ ID NO: 20, or SEQ ID NO: 24 (according to the Kabat definition system), a CDR-H3 having the amino acid sequence of SEQ ID NO: 9 (according to the Kabat definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VH as set forth in SEQ ID NO: 17, SEQ ID NO: 22, or SEQ ID NO: 26. Alternatively or in addition (e.g., in addition), the humanized anti-TfR antibody of the present disclosure comprises a humanized VL comprising a CDR-L1 having the amino acid sequence of SEQ ID NO: 10 (according to the Kabat definition system), a CDR-L2 having the amino acid sequence of SEQ ID NO: 11 (according to the Kabat definition system), and a CDR-L3 having the amino acid sequence of SEQ ID NO: 6 (according to the Kabat definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VL as set forth in SEQ ID NO: 18.

In some embodiments, the humanized anti-TfR antibody of the present disclosure comprises a humanized VH comprising a CDR-H1 having the amino acid sequence of SEQ ID NO: 7 (according to the Kabat definition system), a CDR-H2 having the amino acid sequence of SEQ ID NO: 8, SEQ ID NO: 20, or SEQ ID NO: 24 (according to the Kabat definition system), a CDR-H3 having the amino acid sequence of SEQ ID NO: 9 (according to the Kabat definition system), and is at least 75% (e.g., 75%, 80%, 85%, 90%, 95%, 98%, or 99%) identical in the framework regions to the VH as set forth in SEQ ID NO: 17, SEQ ID NO: 22, or SEQ ID NO: 26. Alternatively or in addition (e.g., in addition), the humanized anti-TfR antibody of the present disclosure comprises a humanized VL comprising a CDR-L1 having the amino acid sequence of SEQ ID NO: 10 (according to the Kabat definition system), a CDR-L2 having the amino acid sequence of SEQ ID NO: 11 (according to the Kabat definition system), and a CDR-L3 having the amino acid sequence of SEQ ID NO: 6 (according to the Kabat definition system), and is at least 75% (e.g., 75%, 80%, 85%, 90%, 95%, 98%, or 99%) identical in the framework regions to the VL as set forth in any one of SEQ ID NO: 18.

In some embodiments, the humanized anti-TfR antibody of the present disclosure comprises a humanized VH comprising a CDR-H1 having the amino acid sequence of SEQ ID NO: 12 (according to the Chothia definition system), a CDR-H2 having the amino acid sequence of SEQ ID NO: 13, SEQ ID NO: 21, or SEQ ID NO: 25 (according to the Chothia definition system), a CDR-H3 having the amino acid sequence of SEQ ID NO: 14 (according to the Chothia definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VH as set forth in SEQ ID NO: 17, SEQ ID NO: 22 or SEQ ID NO: 26. Alternatively or in addition (e.g., in addition), the humanized anti-TfR antibody of the present disclosure comprises a humanized VL comprising a CDR-L1 having the amino acid sequence of SEQ ID NO: 15 (according to the Chothia definition system), a CDR-L2 having the amino acid sequence of SEQ ID NO: 5 (according to the Chothia definition system), and a CDR-L3 having the amino acid sequence of SEQ ID NO: 16 (according to the Chothia definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VL as set forth in SEQ ID NO: 18.

In some embodiments, the humanized anti-TfR antibody of the present disclosure comprises a humanized VH comprising a CDR-H1 having the amino acid sequence of SEQ ID NO: 12 (according to the Chothia definition system), a CDR-H2 having the amino acid sequence of SEQ ID NO: 13, SEQ ID NO: 21, or SEQ ID NO: 25 (according to the Chothia definition system), a CDR-H3 having the amino acid sequence of SEQ ID NO: 14 (according to the Chothia definition system), and is at least 75% (e.g., 75%, 80%, 85%, 90%, 95%, 98%, or 99%) identical in the framework regions to the VH as set forth in SEQ ID NO: SEQ ID NO: 17, SEQ ID NO: 22 or SEQ ID NO: 26. Alternatively or in addition (e.g., in addition), the anti-TfR antibody of the present disclosure comprises a humanized VL comprising a CDR-L1 having the amino acid sequence of SEQ ID NO: 15 (according to the Chothia definition system), a CDR-L2 having the amino acid sequence of SEQ ID NO: 5 (according to the Chothia definition system), and a CDR-L3 having the amino acid sequence of SEQ ID NO: 16 (according to the Chothia definition system), and is at least 75% (e.g., 75%, 80%, 85%, 90%, 95%, 98%, or 99%) identical in the framework regions to the VL as set forth in any one of SEQ ID NO: 18.

In some embodiments, the humanized anti-TfR antibody of the present disclosure comprises a humanized VH comprising a CDR-H1 having the amino acid sequence of SEQ ID NO: 27 (according to the IMGT definition system), a CDR-H2 having the amino acid sequence of SEQ ID NO: 28 (according to the IMGT definition system), a CDR-H3 having the amino acid sequence of SEQ ID NO: 29 (according to the IMGT definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VH as set forth in SEQ ID NO: 43. Alternatively or in addition (e.g., in addition), the humanized anti-TfR antibody of the present disclosure comprises a humanized VL comprising a CDR-L1 having the amino acid sequence of SEQ ID NO: 30 (according to the IMGT definition system), a CDR-L2 having the amino acid sequence of SEQ ID NO: 31 (according to the IMGT definition system), and a CDR-L3 having the amino acid sequence of SEQ ID NO: 32 (according to the IMGT definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VL as set forth in SEQ ID NO: 44.

In some embodiments, the humanized anti-TfR antibody of the present disclosure comprises a humanized VH comprising a CDR-H1 having the amino acid sequence of SEQ ID NO: 27 (according to the IMGT definition system), a CDR-H2 having the amino acid sequence of SEQ ID NO: 28 (according to the IMGT definition system), a CDR-H3 having the amino acid sequence of SEQ ID NO: 29 (according to the IMGT definition system), and is at least 75% (e.g., 75%, 80%, 85%, 90%, 95%, 98%, or 99%) identical in the framework regions to the VH as set forth in SEQ ID NO: 43. Alternatively or in addition (e.g., in addition), the humanized anti-TfR antibody of the present disclosure comprises a humanized VL comprising a CDR-L1 having the amino acid sequence of SEQ ID NO: 30 (according to the IMGT definition system), a CDR-L2 having the amino acid sequence of SEQ ID NO: 31 (according to the IMGT definition system), and a CDR-L3 having the amino acid sequence of SEQ ID NO: 32 (according to the IMGT definition system), and is at least 75% (e.g., 75%, 80%, 85%, 90%, 95%, 98%, or 99%) identical in the framework regions to the VL as set forth in SEQ ID NO: 44.

In some embodiments, the humanized anti-TfR antibody of the present disclosure comprises a humanized VH comprising a CDR-H1 having the amino acid sequence of SEQ ID NO: 33 (according to the Kabat definition system), a CDR-H2 having the amino acid sequence of SEQ ID NO: 34 (according to the Kabat definition system), a CDR-H3 having the amino acid sequence of SEQ ID NO: 35 (according to the Kabat definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VH as set forth in SEQ ID NO: 43. Alternatively or in addition (e.g., in addition), the humanized anti-TfR antibody of the present disclosure comprises a humanized VL comprising a CDR-L1 having the amino acid sequence of SEQ ID NO: 36 (according to the Kabat definition system), a CDR-L2 having the amino acid sequence of SEQ ID NO: 37 (according to the Kabat definition system), and a CDR-L3 having the amino acid sequence of SEQ ID NO: 32 (according to the Kabat definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VL as set forth in SEQ ID NO: 44.

In some embodiments, the humanized anti-TfR antibody of the present disclosure comprises a humanized VH comprising a CDR-H1 having the amino acid sequence of SEQ ID NO: 33 (according to the Kabat definition system), a CDR-H2 having the amino acid sequence of SEQ ID NO: 34 (according to the Kabat definition system), a CDR-H3 having the amino acid sequence of SEQ ID NO: 35 (according to the Kabat definition system), and is at least 75% (e.g., 75%, 80%, 85%, 90%, 95%, 98%, or 99%) identical in the framework regions to the VH as set forth in SEQ ID NO: 43. Alternatively or in addition (e.g., in addition), the humanized anti-TfR antibody of the present disclosure comprises a humanized VL comprising a CDR-L1 having the amino acid sequence of SEQ ID NO: 36 (according to the Kabat definition system), a CDR-L2 having the amino acid sequence of SEQ ID NO: 37 (according to the Kabat definition system), and a CDR-L3 having the amino acid sequence of SEQ ID NO: 32 (according to the Kabat definition system), and is at least 75% (e.g., 75%, 80%, 85%, 90%, 95%, 98%, or 99%) identical in the framework regions to the VL as set forth in SEQ ID NO: 44.

In some embodiments, the humanized anti-TfR antibody of the present disclosure comprises a humanized VH comprising a CDR-H1 having the amino acid sequence of SEQ ID NO: 38 (according to the Chothia definition system), a CDR-H2 having the amino acid sequence of SEQ ID NO: 39 (according to the Chothia definition system), a CDR-H3 having the amino acid sequence of SEQ ID NO: 40 (according to the Chothia definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VH as set forth in SEQ ID NO: 43. Alternatively or in addition (e.g., in addition), the humanized anti-TfR antibody of the present disclosure comprises a humanized VL comprising a CDR-L1 having the amino acid sequence of SEQ ID NO: 41 (according to the Chothia definition system), a CDR-L2 having the amino acid sequence of SEQ ID NO: 31 (according to the Chothia definition system), and a CDR-L3 having the amino acid sequence of SEQ ID NO: 42 (according to the Chothia definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VL as set forth in SEQ ID NO: 44.

In some embodiments, the humanized anti-TfR antibody of the present disclosure comprises a humanized VH comprising a CDR-H1 having the amino acid sequence of SEQ ID NO: 38 (according to the Chothia definition system), a CDR-H2 having the amino acid sequence of SEQ ID NO: 39 (according to the Chothia definition system), a CDR-H3 having the amino acid sequence of SEQ ID NO: 40 (according to the Chothia definition system), and is at least 75% (e.g., 75%, 80%, 85%, 90%, 95%, 98%, or 99%) identical in the framework regions to the VH as set forth in SEQ ID NO: 43. Alternatively or in addition (e.g., in addition), the humanized anti-TfR antibody of the present disclosure comprises a humanized VL comprising a CDR-L1 having the amino acid sequence of SEQ ID NO: 41 (according to the Chothia definition system), a CDR-L2 having the amino acid sequence of SEQ ID NO: 31 (according to the Chothia definition system), and a CDR-L3 having the amino acid sequence of SEQ ID NO: 42 (according to the Chothia definition system), and is at least 75% (e.g., 75%, 80%, 85%, 90%, 95%, 98%, or 99%) identical in the framework regions to the VL as set forth in SEQ ID NO: 44.

In some embodiments, the humanized anti-TfR antibody of the present disclosure comprises a humanized VH comprising a CDR-H1 having the amino acid sequence of SEQ ID NO: 45, SEQ ID NO: 63, or SEQ ID NO: 66 (according to the IMGT definition system), a CDR-H2 having the amino acid sequence of SEQ ID NO: 46 (according to the IMGT definition system), a CDR-H3 having the amino acid sequence of SEQ ID NO: 47 (according to the IMGT definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VH as set forth in SEQ ID NO: 61, SEQ ID NO: 65, or SEQ ID NO: 68. Alternatively or in addition (e.g., in addition), the humanized anti-TfR antibody of the present disclosure comprises a humanized VL comprising a CDR-L1 having the amino acid sequence of SEQ ID NO: 48 (according to the IMGT definition system), a CDR-L2 having the amino acid sequence of SEQ ID NO: 49 (according to the IMGT definition system), and a CDR-L3 having the amino acid sequence of SEQ ID NO: 50 (according to the IMGT definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VL as set forth in SEQ ID NO: 62.

In some embodiments, the humanized anti-TfR antibody of the present disclosure comprises a humanized VH comprising a CDR-H1 having the amino acid sequence of SEQ ID NO: 45, SEQ ID NO: 63, or SEQ ID NO: 66 (according to the IMGT definition system), a CDR-H2 having the amino acid sequence of SEQ ID NO: 46 (according to the IMGT definition system), a CDR-H3 having the amino acid sequence of SEQ ID NO: 47 (according to the IMGT definition system), and is at least 75% (e.g., 75%, 80%, 85%, 90%, 95%, 98%, or 99%) identical in the framework regions to the VH as set forth in SEQ ID NO: 61, SEQ ID NO: 65, SEQ ID NO: 68. Alternatively or in addition (e.g., in addition), the humanized anti-TfR antibody of the present disclosure comprises a humanized VL comprising a CDR-L1 having the amino acid sequence of SEQ ID NO: 48 (according to the IMGT definition system), a CDR-L2 having the amino acid sequence of SEQ ID NO: 49 (according to the IMGT definition system), and a CDR-L3 having the amino acid sequence of SEQ ID NO: 50 (according to the IMGT definition system), and is at least 75% (e.g., 75%, 80%, 85%, 90%, 95%, 98%, or 99%) identical in the framework regions to the VL as set forth in SEQ ID NO: 62.

In some embodiments, the humanized anti-TfR antibody of the present disclosure comprises a humanized VH comprising a CDR-H1 having the amino acid sequence of SEQ ID NO: 51, SEQ ID NO: 64, or SEQ ID NO: 67 (according to the Kabat definition system), a CDR-H2 having the amino acid sequence of SEQ ID NO: 52 (according to the Kabat definition system), a CDR-H3 having the amino acid sequence of SEQ ID NO: 53 (according to the Kabat definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VH as set forth in SEQ ID NO: 61, SEQ ID NO: 65, SEQ ID NO: 68. Alternatively or in addition (e.g., in addition), the humanized anti-TfR antibody of the present disclosure comprises a humanized VL comprising a CDR-L1 having the amino acid sequence of SEQ ID NO: 54 (according to the Kabat definition system), a CDR-L2 having the amino acid sequence of SEQ ID NO: 55 (according to the Kabat definition system), and a CDR-L3 having the amino acid sequence of SEQ ID NO: 50 (according to the Kabat definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VL as set forth in SEQ ID NO: 62.

In some embodiments, the humanized anti-TfR antibody of the present disclosure comprises a humanized VH comprising a CDR-H1 having the amino acid sequence of SEQ ID NO: 51, SEQ ID NO: 64, or SEQ ID NO: 67 (according to the Kabat definition system), a CDR-H2 having the amino acid sequence of SEQ ID NO: 52 (according to the Kabat definition system), a CDR-H3 having the amino acid sequence of SEQ ID NO: 53 (according to the Kabat definition system), and is at least 75% (e.g., 75%, 80%, 85%, 90%, 95%, 98%, or 99%) identical in the framework regions to the VH as set forth in SEQ ID NO: 61, SEQ ID NO: 65, SEQ ID NO: 68. Alternatively or in addition (e.g., in addition), the humanized anti-TfR antibody of the present disclosure comprises a humanized VL comprising a CDR-L1 having the amino acid sequence of SEQ ID NO: 54 (according to the Kabat definition system), a CDR-L2 having the amino acid sequence of SEQ ID NO: 55 (according to the Kabat definition system), and a CDR-L3 having the amino acid sequence of SEQ ID NO: 50 (according to the Kabat definition system), and is at least 75% (e.g., 75%, 80%, 85%, 90%, 95%, 98%, or 99%) identical in the framework regions to the VL as set forth in SEQ ID NO: 62.

In some embodiments, the humanized anti-TfR antibody of the present disclosure comprises a humanized VH comprising a CDR-H1 having the amino acid sequence of SEQ ID NO: 56 (according to the Chothia definition system), a CDR-H2 having the amino acid sequence of SEQ ID NO: 57 (according to the Chothia definition system), a CDR-H3 having the amino acid sequence of SEQ ID NO: 58 (according to the Chothia definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VH as set forth in SEQ ID NO: 61, SEQ ID NO: 65, SEQ ID NO: 68. Alternatively or in addition (e.g., in addition), the humanized anti-TfR antibody of the present disclosure comprises a humanized VL comprising a CDR-L1 having the amino acid sequence of SEQ ID NO: 59 (according to the Chothia definition system), a CDR-L2 having the amino acid sequence of SEQ ID NO: 49 (according to the Chothia definition system), and a CDR-L3 having the amino acid sequence of SEQ ID NO: 60 (according to the Chothia definition system), and containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) in the framework regions as compared with the VL as set forth in SEQ ID NO: 62.

In some embodiments, the humanized anti-TfR antibody of the present disclosure comprises a humanized VH comprising a CDR-H1 having the amino acid sequence of SEQ ID NO: 56 (according to the Chothia definition system), a CDR-H2 having the amino acid sequence of SEQ ID NO: 57 (according to the Chothia definition system), a CDR-H3 having the amino acid sequence of SEQ ID NO: 58 (according to the Chothia definition system), and is at least 75% (e.g., 75%, 80%, 85%, 90%, 95%, 98%, or 99%) identical in the framework regions to the VH as set forth in SEQ ID NO: 61, SEQ ID NO: 65, SEQ ID NO: 68. Alternatively or in addition (e.g., in addition), the humanized anti-TfR antibody of the present disclosure comprises a humanized VL comprising a CDR-L1 having the amino acid sequence of SEQ ID NO: 59 (according to the Chothia definition system), a CDR-L2 having the amino acid sequence of SEQ ID NO: 49 (according to the Chothia definition system), and a CDR-L3 having the amino acid sequence of SEQ ID NO: 60 (according to the Chothia definition system), and is at least 75% (e.g., 75%, 80%, 85%, 90%, 95%, 98%, or 99%) identical in the framework regions to the VL as set forth in SEQ ID NO: 62.

Examples of amino acid sequences of the humanized anti-TfR antibodies described herein are provided in Table 3.

TABLE 3

Variable Regions of Humanized Anti-TfR Antibodies

| Antibody | Variable Region Amino Acid Sequence** |
|---|---|
| 3A4<br>VH3 (N54T*)/Vκ4 | $V_H$:<br>EVQLVQSGSELKKPGASVKVSCTASGFNIKDDYMYWVRQPPGKGLEWIGWID PETGDTEYASKFQDRVTVTADTSTNTAYMELSSLRSEDTAVYYCTLWLRRGL DYWGQGTLVTVSS (SEQ ID NO: 69)<br>$V_L$:<br>DIVMTQSPLSLPVTPGEPASISCRSSKSLLHSNGYTYLFWFQQRPGQSPRLL IYRMSNLASGVPDRFSGSGSGTDFTLKISRVEAEDVGVYYCMQHLEYPFTFG GGTKVEIK (SEQ ID NO: 70) |

TABLE 3-continued

Variable Regions of Humanized Anti-TfR Antibodies

| Antibody | Variable Region Amino Acid Sequence** |
|---|---|
| 3A4<br>VH3 (N54S*)/Vκ4 | V_H:<br>EVQLVQSGSELKKPGASVKVSCTASGFNIKDDYMYWVRQPPGKGLEWIGWIDPESGDTEYASKFQDRVTVTADTSTNTAYMELSSLRSEDTAVYYCTLWLRRGLDYWGQGTLVTVSS (SEQ ID NO: 71)<br>V_L:<br>DIVMTQSPLSLPVTPGEPASISCRSSKSLLHSNGYTYLFWFQQRPGQSPRLLIYRMSNLASGVPDRFSGSGSGTDFTLKISRVEAEDVGVYYCMQHLEYPFTFGGGTKVEIK (SEQ ID NO: 70) |
| 3A4<br>VH3 /Vκ4 | VH:<br>EVQLVQSGSELKKPGASVKVSCTASGFNIKDDYMYWVRQPPGKGLEWIGWIDPENGDTEYASKFQDRVTVTADTSTNTAYMELSSLRSEDTAVYYCTLWLRRGLDYWGQGTLVTVSS (SEQ ID NO: 72)<br>VL:<br>DIVMTQSPLSLPVTPGEPASISCRSSKSLLHSNGYTYLFWFQQRPGQSPRLLIYRMSNLASGVPDRFSGSGSGTDFTLKISRVEAEDVGVYYCMQHLEYPFTFGGGTKVEIK (SEQ ID NO: 70) |
| 3M12<br>VH3/Vκ2 | VH:<br>QVQLQESGPGLVKPSQTLSLTCSVTGYSITSGYYWNWIRQPPGKGLEWMGYITFDGANNYNPSLKNRVSISRDTSKNQFSLKLSSVTAEDTATYYCTRSSYDYDVLDYWGQGTTVTVSS (SEQ ID NO: 73)<br>VL:<br>DIQMTQSPSSLSASVGDRVTITCRASQDISNFLNWYQQKPGQPVKLLIYYTSRLHSGVPSRFSGSGSGTDFTLTISSLQPEDFATYFCQQGHTLPYTFGQGTKLEIK (SEQ ID NO: 74) |
| 3M12<br>VH3/Vκ3 | VH:<br>QVQLQESGPGLVKPSQTLSLTCSVTGYSITSGYYWNWIRQPPGKGLEWMGYITFDGANNYNPSLKNRVSISRDTSKNQFSLKLSSVTAEDTATYYCTRSSYDYDVLDYWGQGTTVTVSS (SEQ ID NO: 73)<br>VL:<br>DIQMTQSPSSLSASVGDRVTITCRASQDISNFLNWYQQKPGQPVKLLIYYTSRLHSGVPSRFSGSGSGTDFTLTISSLQPEDFATYYCQQGHTLPYTFGQGTKLEIK (SEQ ID NO: 75) |
| 3M12<br>VH4/Vκ2 | VH:<br>QVQLQESGPGLVKPSQTLSLTCTVTGYSITSGYYWNWIRQPPGKGLEWIGYITFDGANNYNPSLKNRVSISRDTSKNQFSLKLSSVTAEDTATYYCTRSSYDYDVLDYWGQGTTVTVSS (SEQ ID NO: 76)<br>VL:<br>DIQMTQSPSSLSASVGDRVTITCRASQDISNFLNWYQQKPGQPVKLLIYYTSRLHSGVPSRFSGSGSGTDFTLTISSLQPEDFATYFCQQGHTLPYTFGQGTKLEIK (SEQ ID NO: 74) |
| 3M12<br>VH4/Vκ3 | VH:<br>QVQLQESGPGLVKPSQTLSLTCTVTGYSITSGYYWNWIRQPPGKGLEWIGYITFDGANNYNPSLKNRVSISRDTSKNQFSLKLSSVTAEDTATYYCTRSSYDYDVLDYWGQGTTVTVSS (SEQ ID NO: 76)<br>VL:<br>DIQMTQSPSSLSASVGDRVTITCRASQDISNFLNWYQQKPGQPVKLLIYYTSRLHSGVPSRFSGSGSGTDFTLTISSLQPEDFATYYCQQGHTLPYTFGQGTKLEIK (SEQ ID NO: 75) |
| 5H12<br>VH5 (C33Y*)/Vκ3 | VH:<br>QVQLVQSGAEVKKPGASVKVSCKASGYSFTDYYINWVRQAPGQGLEWMGWIYPGSGNTRYSERFKGRVTITRDTSASTAYMELSSLRSEDTAVYYCAREDYYPYHGMDYWGQGTLVTVSS (SEQ ID NO: 77)<br>VL:<br>DIVLTQSPDSLAVSLGERATINCRASESVDGYDNSFMHWYQQKPGQPPKLLIFRASNLESGVPDRFSGSGSRTDFTLTISSLQAEDVAVYYCQQSSEDPWTFGQGTKLEIK (SEQ ID NO: 78) |
| 5H12<br>VH5 (C33D*)/Vκ4 | VH:<br>QVQLVQSGAEVKKPGASVKVSCKASGYSFTDYDINWVRQAPGQGLEWMGWIYPGSGNTRYSERFKGRVTITRDTSASTAYMELSSLRSEDTAVYYCAREDYYPYHGMDYWGQGTLVTVSS (SEQ ID NO: 79)<br>VL:<br>DIVMTQSPDSLAVSLGERATINCRASESVDGYDNSFMHWYQQKPGQPPKLLIFRASNLESGVPDRFSGSGSGTDFTLTISSLQAEDVAVYYCQQSSEDPWTFGQGTKLEIK (SEQ ID NO: 80) |

TABLE 3-continued

Variable Regions of Humanized Anti-TfR Antibodies

| Antibody | Variable Region Amino Acid Sequence** |
|---|---|
| 5H12<br>VH5 (C33Y*)/Vκ4 | VH:<br>QVQLVQSGAEVKKPGASVKVSCKASGYSFTDYYINWVRQAPGQGLEWMGWIY<br>PGSGNTRYSERFKGRVTITRDTSASTAYMELSSLRSEDTAVYYCAREDYYPY<br>HGMDYWGQGTLVTVSS (SEQ ID NO: 77)<br>VL:<br>DIVMTQSPDSLAVSLGERATINCRASESVDGYDNSFMHWYQQKPGQPPKLLI<br>FRASNLESGVPDRFSGSGSGTDFTLTISSLQAEDVAVYYCQQSSEDPWTFGQ<br>GTKLEIK (SEQ ID NO: 80) |

*mutation positions are according to Kabat numbering of the respective VH sequences containing the mutations
**CDRs according to the Kabat numbering system are bolded In some embodiments, the humanized anti-TfR antibody of the present disclosure comprises a humanized VH comprising the CDR-H1, CDR-H2, and CDR-H3 of any one of the anti-TfR antibodies provided in Table 2 and comprises one or more (e.g., 1, 2, 3, 4, 5, 6, 7, 8, 9, 10 or more) amino acid variations in the framework regions as compared with the respective humanized VH provided in Table 3. Alternatively or in addition (e.g., in addition), the humanized anti-TfR antibody of the present disclosure comprises a humanized VL comprising the CDR-L1, CDR-L2, and CDR-L3 of any one of the anti-TfR antibodies provided in Table 2 and comprises one or more (e.g., 1, 2, 3, 4, 5, 6, 7, 8, 9, 10 or more) amino acid variations in the framework regions as compared with the respective humanized VL provided in Table 3.

In some embodiments, the humanized anti-TfR antibody of the present disclosure comprises a humanized VH comprising an amino acid sequence that is at least 80% (e.g., 80%, 85%, 90%, 95%, 98%, or 99%) identical to SEQ ID NO: 69, and/or (e.g., and) a humanized VL comprising an amino acid sequence that is at least 80% identical (e.g., 80%, 85%, 90%, 95%, 98%, or 99%) to SEQ ID NO: 70. In some embodiments, the humanized anti-TfR antibody of the present disclosure comprises a humanized VH comprising the amino acid sequence of SEQ ID NO: 69 and a humanized VL comprising the amino acid sequence of SEQ ID NO: 70.

In some embodiments, the humanized anti-TfR antibody of the present disclosure comprises a humanized VH comprising an amino acid sequence that is at least 80% (e.g., 80%, 85%, 90%, 95%, 98%, or 99%) identical to SEQ ID NO: 71, and/or (e.g., and) a humanized VL comprising an amino acid sequence that is at least 80% identical (e.g., 80%, 85%, 90%, 95%, 98%, or 99%) to SEQ ID NO: 70. In some embodiments, the humanized anti-TfR antibody of the present disclosure comprises a humanized VH comprising the amino acid sequence of SEQ ID NO: 71 and a humanized VL comprising the amino acid sequence of SEQ ID NO: 70.

In some embodiments, the humanized anti-TfR antibody of the present disclosure comprises a humanized VH comprising an amino acid sequence that is at least 80% (e.g., 80%, 85%, 90%, 95%, 98%, or 99%) identical to SEQ ID NO: 72, and/or (e.g., and) a humanized VL comprising an amino acid sequence that is at least 80% identical (e.g., 80%, 85%, 90%, 95%, 98%, or 99%) to SEQ ID NO: 70. In some embodiments, the humanized anti-TfR antibody of the present disclosure comprises a humanized VH comprising the amino acid sequence of SEQ ID NO: 72 and a humanized VL comprising the amino acid sequence of SEQ ID NO: 70.

In some embodiments, the humanized anti-TfR antibody of the present disclosure comprises a humanized VH comprising an amino acid sequence that is at least 80% (e.g., 80%, 85%, 90%, 95%, 98%, or 99%) identical to SEQ ID NO: 73, and/or (e.g., and) a humanized VL comprising an amino acid sequence that is at least 80% identical (e.g., 80%, 85%, 90%, 95%, 98%, or 99%) to SEQ ID NO: 74. In some embodiments, the humanized anti-TfR antibody of the present disclosure comprises a humanized VH comprising the amino acid sequence of SEQ ID NO: 73 and a humanized VL comprising the amino acid sequence of SEQ ID NO: 74.

In some embodiments, the humanized anti-TfR antibody of the present disclosure comprises a humanized VH comprising an amino acid sequence that is at least 80% (e.g., 80%, 85%, 90%, 95%, 98%, or 99%) identical to SEQ ID NO: 73, and/or (e.g., and) a humanized VL comprising an amino acid sequence that is at least 80% identical (e.g., 80%, 85%, 90%, 95%, 98%, or 99%) to SEQ ID NO: 75. In some embodiments, the humanized anti-TfR antibody of the present disclosure comprises a humanized VH comprising the amino acid sequence of SEQ ID NO: 73 and a humanized VL comprising the amino acid sequence of SEQ ID NO: 75.

In some embodiments, the humanized anti-TfR antibody of the present disclosure comprises a humanized VH comprising an amino acid sequence that is at least 80% (e.g., 80%, 85%, 90%, 95%, 98%, or 99%) identical to SEQ ID NO: 76, and/or (e.g., and) a humanized VL comprising an amino acid sequence that is at least 80% identical (e.g., 80%, 85%, 90%, 95%, 98%, or 99%) to SEQ ID NO: 74. In some embodiments, the humanized anti-TfR antibody of the present disclosure comprises a humanized VH comprising the amino acid sequence of SEQ ID NO: 76 and a humanized VL comprising the amino acid sequence of SEQ ID NO: 74.

In some embodiments, the humanized anti-TfR antibody of the present disclosure comprises a humanized VH comprising an amino acid sequence that is at least 80% (e.g., 80%, 85%, 90%, 95%, 98%, or 99%) identical to SEQ ID NO: 76, and/or (e.g., and) a humanized VL comprising an amino acid sequence that is at least 80% identical (e.g., 80%, 85%, 90%, 95%, 98%, or 99%) to SEQ ID NO: 75. In some embodiments, the humanized anti-TfR antibody of the present disclosure comprises a humanized VH comprising the amino acid sequence of SEQ ID NO: 76 and a humanized VL comprising the amino acid sequence of SEQ ID NO: 75.

In some embodiments, the humanized anti-TfR antibody of the present disclosure comprises a humanized VH comprising an amino acid sequence that is at least 80% (e.g., 80%, 85%, 90%, 95%, 98%, or 99%) identical to SEQ ID NO: 77, and/or (e.g., and) a humanized VL comprising an amino acid sequence that is at least 80% identical (e.g., 80%, 85%, 90%, 95%, 98%, or 99%) to SEQ ID NO: 78. In some embodiments, the humanized anti-TfR antibody of the present disclosure comprises a humanized VH comprising the amino acid sequence of SEQ ID NO: 77 and a humanized VL comprising the amino acid sequence of SEQ ID NO: 78.

In some embodiments, the humanized anti-TfR antibody of the present disclosure comprises a humanized VH comprising an amino acid sequence that is at least 80% (e.g., 80%, 85%, 90%, 95%, 98%, or 99%) identical to SEQ ID NO: 79, and/or (e.g., and) a humanized VL comprising an amino acid sequence that is at least 80% identical (e.g., 80%, 85%, 90%, 95%, 98%, or 99%) to SEQ ID NO: 80. In some embodiments, the humanized anti-TfR antibody of the present disclosure comprises a humanized VH comprising the amino acid sequence of SEQ ID NO: 79 and a humanized VL comprising the amino acid sequence of SEQ ID NO: 80.

In some embodiments, the humanized anti-TfR antibody of the present disclosure comprises a humanized VH comprising an amino acid sequence that is at least 80% (e.g., 80%, 85%, 90%, 95%, 98%, or 99%) identical to SEQ ID NO: 77, and/or (e.g., and) a humanized VL comprising an amino acid sequence that is at least 80% identical (e.g., 80%, 85%, 90%, 95%, 98%, or 99%) to SEQ ID NO: 80. In some embodiments, the humanized anti-TfR antibody of the present disclosure comprises a humanized VH comprising the amino acid sequence of SEQ ID NO: 77 and a humanized VL comprising the amino acid sequence of SEQ ID NO: 80.

In some embodiments, the humanized anti-TfR antibody described herein is a full-length IgG, which can include a heavy constant region and a light constant region from a human antibody. In some embodiments, the heavy chain of any of the anti-TfR antibodies as described herein may comprises a heavy chain constant region (CH) or a portion thereof (e.g., CH1, CH2, CH3, or a combination thereof). The heavy chain constant region can of any suitable origin, e.g., human, mouse, rat, or rabbit. In one specific example, the heavy chain constant region is from a human IgG (a gamma heavy chain), e.g., IgG1, IgG2, or IgG4. An example of a human IgG1 constant region is given below:

(SEQ ID NO: 81)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSRDELTKNQVSLTC

LVKGFYPSDIAVEWESNGQPENNYKTTPPVLDSDGSFFLYSKLTVDKSRW

QQGNVFSCSVMHEALHNHYTQKSLSLSPGK

In some embodiments, the heavy chain of any of the anti-TfR antibodies described herein comprises a mutant human IgG1 constant region. For example, the introduction of LALA mutations (a mutant derived from mAb b12 that has been mutated to replace the lower hinge residues Leu234 Leu235 with Ala234 and Ala235) in the CH2 domain of human IgG1 is known to reduce Fcg receptor binding (Bruhns, P., et al. (2009) and Xu, D. et al. (2000)). The mutant human IgG1 constant region is provided below (mutations bonded and underlined):

(SEQ ID NO: 82)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

-continued
KSCDKTHTCPPCPAPEAAGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSRDELTKNQVSLTC

LVKGFYPSDIAVEWESNGQPENNYKTTPPVLDSDGSFFLYSKLTVDKSRW

QQGNVFSCSVMHEALHNHYTQKSLSLSPGK

In some embodiments, the light chain of any of the anti-TfR antibodies described herein may further comprise a light chain constant region (CL), which can be any CL known in the art. In some examples, the CL is a kappa light chain. In other examples, the CL is a lambda light chain. In some embodiments, the CL is a kappa light chain, the sequence of which is provided below:

(SEQ ID NO: 83)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC

Other antibody heavy and light chain constant regions are well known in the art, e.g., those provided in the IMGT database (www.imgt.org) or at www.vbase2.org/vbstat.php., both of which are incorporated by reference herein.

In some embodiments, the humanized anti-TfR antibody described herein comprises a heavy chain comprising any one of the VH as listed in Table 3 or any variants thereof and a heavy chain constant region that is at least 80%, at least 85%, at least 90%, at least 95%, or at least 99% identical to SEQ ID NO: 81 or SEQ ID NO: 82. In some embodiments, the humanized anti-TfR antibody described herein comprises a heavy chain comprising any one of the VH as listed in Table 3 or any variants thereof and a heavy chain constant region that contains no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) as compared with SEQ ID NO: 81 or SEQ ID NO: 82. In some embodiments, the humanized anti-TfR antibody described herein comprises a heavy chain comprising any one of the VH as listed in Table 3 or any variants thereof and a heavy chain constant region as set forth in SEQ ID NO: 81. In some embodiments, the humanized anti-TfR antibody described herein comprises heavy chain comprising any one of the VH as listed in Table 3 or any variants thereof and a heavy chain constant region as set forth in SEQ ID NO: 82.

In some embodiments, the humanized anti-TfR antibody described herein comprises a light chain comprising any one of the VL as listed in Table 3 or any variants thereof and a light chain constant region that is at least 80%, at least 85%, at least 90%, at least 95%, or at least 99% identical to SEQ ID NO: 83. In some embodiments, the humanized anti-TfR antibody described herein comprises a light chain comprising any one of the VL as listed in Table 3 or any variants thereof and a light chain constant region contains no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) as compared with SEQ ID NO: 83. In some embodiments, the humanized anti-TfR antibody described herein comprises a light chain comprising any one of the VL as listed in Table 3 or any variants thereof and a light chain constant region set forth in SEQ ID NO: 83.

Examples of IgG heavy chain and light chain amino acid sequences of the anti-TfR antibodies described are provided in Table 4 below.

TABLE 4

Heavy chain and light chain sequences of examples of humanized anti-TfR IgGs

| Antibody | IgG Heavy Chain/Light Chain Sequences** |
|---|---|
| 3A4 VH3 (N54T*)/Vκ4 | Heavy Chain (with wild type human IgG1 constant region)<br>EVQLVQSGSELKKPGASVKVSCTASGFNIKDDYMYWVRQPPGKGLEWIGWIDPE TGDTEYASKFQDRVTVTADTSTNTAYMELSSLRSEDTAVYYCTLWLRRGLDYWG QGTLVTVSSASTKGPSVFPLAPSSKSTSGGTAALGCLVKDYFPEPVTVSWNSGA LTSGVHTFPAVLQSSGLYSLSSVVTVPSSSLGTQTYICNVNHKPSNTKVDKKVE PKSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKVS NKALPAPIEKTISKAKGQPREPQVYTLPPSRDELTKNQVSLTCLVKGFYPSDIA BEWESNGQPENNYKTTPPVLDSDGSFFLYSKLTVDKSRWQQGNVFSCSVMHEAL HNHYTQKSLSLSPGK (SEQ ID NO: 84)<br>Light Chain (with kappa light chain constant region)<br>DIVMTQSPLSLPVTPGEPASISCRSSKSLLHSNGYTYLFWFQQRPGQSPRLLIY RMSNLASGVPDRFSGSGSGTDFTLKISRVEAEDVGVYYCMQHLEYPFTFGGGTK VEIKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSFNR GEC (SEQ ID NO: 85) |
| 3A4 VH3 (N54S*)/Vκ4 | Heavy Chain (with wild type human IgG1 constant region)<br>EVQLVQSGSELKKPGASVKVSCTASGFNIKDDYMYWVRQPPGKGLEWIGWIDPE SGDTEYASKFQDRVTVTADTSTNTAYMELSSLRSEDTAVYYCTLWLRRGLDYWG QGTLVTVSSASTKGPSVFPLAPSSKSTSGGTAALGCLVKDYFPEPVTVSWNSGA LTSGVHTFPAVLQSSGLYSLSSVVTVPSSSLGTQTYICNVNHKPSNTKVDKKVE PKSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKVS NKALPAPIEKTISKAKGQPREPQVYTLPPSRDELTKNQVSLTCLVKGFYPSDIA VEWESNGQPENNYKTTPPVLDSDGSFFLYSKLTVDKSRWQQGNVFSCSVMHEAL HNHYTQKSLSLSPGK (SEQ ID NO: 86)<br>Light Chain (with kappa light chain constant region)<br>DIVMTQSPLSLPVTPGEPASISCRSSKSLLHSNGYTYLFWFQQRPGQSPRLLIY RMSNLASGVPDRFSGSGSGTDFTLKISRVEAEDVGVYYCMQHLEYPFTFGGGTK VEIKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSFNR GEC (SEQ ID NO: 85) |
| 3A4 VH3/Vκ4 | Heavy Chain (with wild type human IgG1 constant region)<br>EVQLVQSGSELKKPGASVKVSCTASGFNIKDDYMYWVRQPPGKGLEWIGWIDPE NGDTEYASKFQDRVTVTADTSTNTAYMELSSLRSEDTAVYYCTLWLRRGLDYWG QGTLVTVSSASTKGPSVFPLAPSSKSTSGGTAALGCLVKDYFPEPVTVSWNSGA LTSGVHTFPAVLQSSGLYSLSSVVTVPSSSLGTQTYICNVNHKPSNTKVDKKVE PKSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKVS NKALPAPIEKTISKAKGQPREPQVYTLPPSRDELTKNQVSLTCLVKGFYPSDIA VEWESNGQPENNYKTTPPVLDSDGSFFLYSKLTVDKSRWQQGNVFSCSVMHEAL HNHYTQKSLSLSPGK (SEQ ID NO: 87)<br>Light Chain (with kappa light chain constant region)<br>DIVMTQSPLSLPVTPGEPASISCRSSKSLLHSNGYTYLFWFQQRPGQSPRLLIY RMSNLASGVPDRFSGSGSGTDFTLKISRVEAEDVGVYYCMQHLEYPFTFGGGTK VEIKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSFNR GEC (SEQ ID NO: 85) |
| 3M12 VH3/Vκ2 | Heavy Chain (with wild type human IgG1 constant region)<br>QVQLQESGPGLVKPSQTLSLTCSVTGYSITSGYYWNWIRQPPGKGLEWMGYITF DGANNYNPSLKNRVSISRDTSKNQFSLKLSSVTAEDTATYYCTRSSYDYDVLDY WGQGTTVTVSSASTKGPSVFPLAPSSKSTSGGTAALGCLVKDYFPEPVTVSWNS GALTSGVHTFPAVLQSSGLYSLSSVVTVPSSSLGTQTYICNVNHKPSNTKVDKK VEPKSCDKTHTCPPCPAPELLGGPSVFLFPPKPKDTLMISRTPEVTCVVVDVSH EDPEVKFNWYVDGVEVHNAKTKPREEQYNSTYRVVSVLTVLHQDWLNGKEYKCK VSNKALPAPIEKTISKAKGQPREPQVYTLPPSRDELTKNQVSLTCLVKGFYPSD IAVEWESNGQPENNYKTTPPVLDSDGSFFLYSKLTVDKSRWQQGNVFSCSVMHE ALHNHYTQKSLSLSPGK (SEQ ID NO: 88)<br>Light Chain (with kappa light chain constant region)<br>DIQMTQSPSSLSASVGDRVTITCRASQDISNFLNWYQQKPGQPVKLLIYYTSRL HSGVPSRFSGSGSGTDFTLTISSLQPEDFATYFCQQGHTLPYTFGQGTKLEIKR TVAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC (SEQ ID NO: 89) |
| 3M12 VH3/Vκ3 | Heavy Chain (with wild type human IgG1 constant region)<br>QVQLQESGPGLVKPSQTLSLTCSVTGYSITSGYYWNWIRQPPGKGLEWMGYITF DGANNYNPSLKNRVSISRDTSKNQFSLKLSSVTAEDTATYYCTRSSYDYDVLDY WGQGTTVTVSSASTKGPSVFPLAPSSKSTSGGTAALGCLVKDYFPEPVTVSWNS GALTSGVHTFPAVLQSSGLYSLSSVVTVPSSSLGTQTYICNVNHKPSNTKVDKK VEPKSCDKTHTCPPCPAPELLGGPSVFLFPPKPKDTLMISRTPEVTCVVVDVSH EDPEVKFNWYVDGVEVHNAKTKPREEQYNSTYRVVSVLTVLHQDWLNGKEYKCK |

TABLE 4-continued

Heavy chain and light chain sequences of examples of humanized anti-TfR IgGs

| Antibody | IgG Heavy Chain/Light Chain Sequences** |
|---|---|
| | VSNKALPAPIEKTISKAKGQPREPQVYTLPPSRDELTKNQVSLTCLVKGFYPSD<br>IAVEWESNGQPENNYKTTPPVLDSDGSFFLYSKLTVDKSRWQQGNVFSCSVMHE<br>ALHNHYTQKSLSLSPGK (SEQ ID NO: 88)<br>Light Chain (with kappa light chain constant region)<br>DIQMTQSPSSLSASVGDRVTITCRASQDISNFLNWYQQKPGQPVKLLIYYTSRL<br>HSGVPSRFSGSGSGTDFTLTISSLQPEDFATYYCQQGHTLPYTFGQGTKLEIKR<br>TVAAPSVFIFPPSDEQLKSGTASVVCLLNNFYPREAKVQWKVDNALQSGNSQES<br>VTEQDSKDSTYSLSSTLTLSKADYEKHKVYACEVTHQGLSSPVTKSFNRGEC<br>(SEQ ID NO: 90) |
| 3M12<br>VH4/Vκ2 | Heavy Chain (with wild type human IgG1 constant region)<br>QVQLQESGPGLVKPSQTLSLTCTVTGYSITSGYYWNWIRQPPGKGLEWIGYITF<br>DGANNYNPSLKNRVSISRDTSKNQFSLKLSSVTAEDTATYYCTRSSYDYDVLDY<br>WGQGTTVTVSSASTKGPSVFPLAPSSKSTSGGTAALGCLVKDYFPEPVTVSWNS<br>GALTSGVHTFPAVLQSSGLYSLSSVVTVPSSSLGTQTYICNVNHKPSNTKVDKK<br>VEPKSCDKTHTCPPCPAPELLGGPSVFLFPPKPKDTLMISRTPEVTCVVVDVSH<br>EDPEVKFNWYVDGVEVHNAKTKPREEQYNSTYRVVSVLTVLHQDWLNGKEYKCK<br>VSNKALPAPIEKTISKAKGQPREPQVYTLPPSRDELTKNQVSLTCLVKGFYPSD<br>IAVEWESNGQPENNYKTTPPVLDSDGSFFLYSKLTVDKSRWQQGNVFSCSVMHE<br>ALHNHYTQKSLSLSPGK (SEQ ID NO: 91)<br>Light Chain (with kappa light chain constant region)<br>DIQMTQSPSSLSASVGDRVTITCRASQDISNFLNWYQQKPGQPVKLLIYYTSRL<br>HSGVPSRFSGSGSGTDFTLTISSLQPEDFATYCQQGHTLPYTFGQGTKLEIKR<br>TVAAPSVFIFPPSDEQLKSGTASVVCLLNNFYPREAKVQWKVDNALQSGNSQES<br>VTEQDSKDSTYSLSSTLTLSKADYEKHKVYACEVTHQGLSSPVTKSFNRGEC<br>(SEQ ID NO: 89) |
| 3M12<br>VH4/Vκ3 | Heavy Chain (with wild type human IgG1 constant region)<br>QVQLQESGPGLVKPSQTLSLTCTVTGYSITSGYYWNWIRQPPGKGLEWIGYITF<br>DGANNYNPSLKNRVSISRDTSKNQFSLKLSSVTAEDTATYYCTRSSYDYDVLDY<br>WGQGTTVTVSSASTKGPSVFPLAPSSKSTSGGTAALGCLVKDYFPEPVTVSWNS<br>GALTSGVHTFPAVLQSSGLYSLSSVVTVPSSSLGTQTYICNVNHKPSNTKVDKK<br>VEPKSCDKTHTCPPCPAPELLGGPSVFLFPPKPKDTLMISRTPEVTCVVVDVSH<br>EDPEVKFNWYVDGVEVHNAKTKPREEQYNSTYRVVSVLTVLHQDWLNGKEYKCK<br>VSNKALPAPIEKTISKAKGQPREPQVYTLPPSRDELTKNQVSLTCLVKGFYPSD<br>IAVEWESNGQPENNYKTTPPVLDSDGSFFLYSKLTVDKSRWQQGNVFSCSVMHE<br>ALHNHYTQKSLSLSPGK (SEQ ID NO: 91)<br>Light Chain (with kappa light chain constant region)<br>DIQMTQSPSSLSASVGDRVTITCRASQDISNFLNWYQQKPGQPVKLLIYYTSRL<br>HSGVPSRFSGSGSGTDFTLTISSLQPEDFATYYCQQGHTLPYTFGQGTKLEIKR<br>TVAAPSVFIFPPSDEQLKSGTASVVCLLNNFYPREAKVQWKVDNALQSGNSQES<br>VTEQDSKDSTYSLSSTLTLSKADYEKHKVYACEVTHQGLSSPVTKSFNRGEC<br>(SEQ ID NO: 90) |
| 5H12<br>VH5 (C33Y*)/Vκ3 | Heavy Chain (with wild type human IgG1 constant region)<br>QVQLVQSGAEVKKPGASVKVSCKASGYSFTDYYINWVRQAPGQGLEWMGWIYPG<br>SGNTRYSERFKGRVTITRDTSASTAYMELSSLRSEDTAVYYCAREDYYPYHGMD<br>YWGQGTLVTVSSASTKGPSVFPLAPSSKSTSGGTAALGCLVKDYFPEPVTVSWN<br>SGALTSGVHTFPAVLQSSGLYSLSSVVTVPSSSLGTQTYICNVNHKPSNTKVDK<br>KVEPKSCDKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCLVKGFYPS<br>DIAVEWESNGQPENNYKTTPPVLDSDGSFFLYSKLTVDKSRWQQGNVFSCSVMH<br>EALHNHYTQKSLSLSPGK (SEQ ID NO: 92)<br>Light Chain (with kappa light chain constant region)<br>DIVLTQSPDSLAVSLGERATINCRASESVDGYDNSFMHWYQQKPGQPPKLLIFR<br>ASNLESGVPDRFSGSGSRTDFTLTISSLQAEDVAVYYCQQSSEDPWTFGQGTKL<br>EIKRTVAAPSVFIFPPSDEQLKSGTASVVCLLNNFYPREAKVQWKVDNALQSGN<br>SQESVTEQDSKDSTYSLSSTLTLSKADYEKHKVYACEVTHQGLSSPVTKSFNRG<br>EC (SEQ ID NO: 93) |
| 5H12<br>VH5 (C33D*)/Vκ4 | Heavy Chain (with wild type human IgG1 constant region)<br>QVQLVQSGAEVKKPGASVKVSCKASGYSFTDYDINWVRQAPGQGLEWMGWIYPG<br>SGNTRYSERFKGRVTITRDTSASTAYMELSSLRSEDTAVYYCAREDYYPYHGMD<br>YWGQGTLVTVSSASTKGPSVFPLAPSSKSTSGGTAALGCLVKDYFPEPVTVSWN<br>SGALTSGVHTFPAVLQSSGLYSLSSVVTVPSSSLGTQTYICNVNHKPSNTKVDK<br>KVEPKSCDKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCLVKGFYPS<br>DIAVEWESNGQPENNYKTTPPVLDSDGSFFLYSKLTVDKSRWQQGNVFSCSVMH<br>EALHNHYTQKSLSLSPGK (SEQ ID NO: 94) |

TABLE 4-continued

Heavy chain and light chain sequences of examples of humanized anti-TfR IgGs

| Antibody | IgG Heavy Chain/Light Chain Sequences** |
|---|---|
| | Light Chain (with kappa light chain constant region)<br>DIVMTQSPDSLAVSLGERATINCRASESVDGYDNSFMHWYQQKPGQPPKLLIFR<br>ASNLESGVPDRFSGSGSGTDFTLTISSLQAEDVAVYYCQQSSEDPWTFGQGTKL<br>EIKRTVAAPSVFIFPPSDEQLKSGTASVVCLLNNFYPREAKVQWKVDNALQSGN<br>SQESVTEQDSKDSTYSLSSTLTLSKADYEKHKVYACEVTHQGLSSPVTKSFNRG<br>EC (SEQ ID NO: 95) |
| 5H12<br>VH5 (C33Y*)/Vκ4 | Heavy Chain (with wild type human IgG1 constant region)<br>QVQLVQSGAEVKKPGASVKVSCKASGYSFTDYYINWVRQAPGQGLEWMGWIYPG<br>SGNTRYSERFKGRVTITRDTSASTAYMELSSLRSEDTAVYYCAREDYYPYHGMD<br>YWGQGTLVTVSSASTKGPSVFPLAPSSKSTSGGTAALGCLVKDYFPEPVTVSWN<br>SGALTSGVHTFPAVLQSSGLYSLSSVVTVPSSSLGTQTYICNVNHKPSNTKVDK<br>KVEPKSCDKTHTCPPCPAPELLGGPSVFLFPPKPKDTLMISRTPEVTCVVVDVS<br>HEDPEVKFNWYVDGVEVHNAKTKPREEQYNSTYRVVSVLTVLHQDWLNGKEYKC<br>KVSNKALPAPIEKTISKAKGQPREPQVYTLPPSRDELTKNQVSLTCLVKGFYPS<br>DIAVEWESNGQPENNYKTTPPVLDSDGSFFLYSKLTVDKSRWQQGNVFSCSVMH<br>EALHNHYTQKSLSLSPGK (SEQ ID NO: 92)<br>Light Chain (with kappa light chain constant region)<br>DIVMTQSPDSLAVSLGERATINCRASESVDGYDNSFMHWYQQKPGQPPKLLIFR<br>ASNLESGVPDRFSGSGSGTDFTLTISSLQAEDVAVYYCQQSSEDPWTFGQGTKL<br>EIKRTVAAPSVFIFPPSDEQLKSGTASVVCLLNNFYPREAKVQWKVDNALQSGN<br>SQESVTEQDSKDSTYSLSSTLTLSKADYEKHKVYACEVTHQGLSSPVTKSFNRG<br>EC (SEQ ID NO: 95) |

*mutation positions are according to Kabat numbering of the respective VH sequences containing the mutations
**CDRs according to the Kabat numbering system are bolded; VH/VL sequences underlined In some embodiments, the humanized anti-TfR antibody of the present disclosure comprises a heavy chain containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) as compared with the heavy chain as set forth in any one of SEQ ID NOs: 84, 86, 87, 88, 91, 92, and 94. Alternatively or in addition (e.g., in addition), the humanized anti-TfR antibody of the present disclosure comprises a light chain containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) as compared with the light chain as set forth in any one of SEQ ID NOs: 85, 89, 90, 93, and 95.

In some embodiments, the humanized anti-TfR antibody described herein comprises a heavy chain comprising an amino acid sequence that is at least 75% (e.g., 75%, 80%, 85%, 90%, 95%, 98%, or 99%) identical to any one of SEQ ID NOs: 84, 86, 87, 88, 91, 92, and 94. Alternatively or in addition (e.g., in addition), the humanized anti-TfR antibody described herein comprises a light chain comprising an amino acid sequence that is at least 75% (e.g., 75%, 80%, 85%, 90%, 95%, 98%, or 99%) identical to any one of SEQ ID NOs: 85, 89, 90, 93, and 95. In some embodiments, the anti-TfR antibody described herein comprises a heavy chain comprising the amino acid sequence of any one of SEQ ID NOs: 84, 86, 87, 88, 91, 92, and 94. Alternatively or in addition (e.g., in addition), the anti-TfR antibody described herein comprises a light chain comprising the amino acid sequence of any one of SEQ ID NOS: 85, 89, 90, 93, and 95.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 84, and/or (e.g., and) a light chain comprising an amino acid sequence that is at least 80% identical (e.g., 80%, 85%, 90%, 95%, 98%, or 99%) to SEQ ID NO: 85. In some embodiments, the humanized anti-TfR antibody of the present disclosure comprises a heavy chain comprising the amino acid sequence of SEQ ID NO: 84 and a light chain comprising the amino acid sequence of SEQ ID NO: 85.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 86, and/or (e.g., and) a light chain comprising an amino acid sequence that is at least 80% identical (e.g., 80%, 85%, 90%, 95%, 98%, or 99%) to SEQ ID NO: 85. In some embodiments, the humanized anti-TfR antibody of the present disclosure comprises a heavy chain comprising the amino acid sequence of SEQ ID NO: 86 and a light chain comprising the amino acid sequence of SEQ ID NO: 85.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 87, and/or (e.g., and) a light chain comprising an amino acid sequence that is at least 80% identical (e.g., 80%, 85%, 90%, 95%, 98%, or 99%) to SEQ ID NO: 85. In some embodiments, the humanized anti-TfR antibody of the present disclosure comprises a heavy chain comprising the amino acid sequence of SEQ ID NO: 87 and a light chain comprising the amino acid sequence of SEQ ID NO: 85.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 88, and/or (e.g., and) a light chain comprising an amino acid sequence that is at least 80% identical (e.g., 80%, 85%, 90%, 95%, 98%, or 99%) to SEQ ID NO: 89. In some embodiments, the humanized anti-TfR antibody of the present disclosure comprises a heavy chain comprising the amino acid sequence of SEQ ID NO: 88 and a light chain comprising the amino acid sequence of SEQ ID NO: 89.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 88, and/or (e.g., and) a light chain comprising an amino acid sequence that is at least 80% identical (e.g., 80%, 85%, 90%, 95%, 98%, or 99%) to SEQ ID NO: 90. In some embodiments, the humanized anti-TfR antibody of the present disclosure comprises a heavy chain comprising the amino acid sequence of SEQ ID NO: 88 and a light chain comprising the amino acid sequence of SEQ ID NO: 90.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 91, and/or (e.g., and) a light chain comprising an amino acid sequence that is at least 80% identical (e.g., 80%, 85%, 90%, 95%, 98%, or 99%) to SEQ ID NO: 89. In some embodiments, the humanized anti-TfR antibody of the present disclosure comprises a heavy chain comprising the amino acid sequence of SEQ ID NO: 91 and a light chain comprising the amino acid sequence of SEQ ID NO: 89.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 91, and/or (e.g., and) a light chain comprising an amino acid sequence that is at least 80% identical (e.g., 80%, 85%, 90%, 95%, 98%, or 99%) to SEQ ID NO: 90. In some embodiments, the humanized anti-TfR antibody of the present disclosure comprises a heavy chain comprising the amino acid sequence of SEQ ID NO: 91 and a light chain comprising the amino acid sequence of SEQ ID NO: 90.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 92, and/or (e.g., and) a light chain comprising an amino acid sequence that is at least 80% identical (e.g., 80%, 85%, 90%, 95%, 98%, or 99%) to SEQ ID NO: 93. In some embodiments, the humanized anti-TfR antibody of the present disclosure comprises a heavy chain comprising the amino acid sequence of SEQ ID NO: 92 and a light chain comprising the amino acid sequence of SEQ ID NO: 93.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 94, and/or (e.g., and) a light chain comprising an amino acid sequence that is at least 80% identical (e.g., 80%, 85%, 90%, 95%, 98%, or 99%) to SEQ ID NO: 95. In some embodiments, the humanized anti-TfR antibody of the present disclosure comprises a heavy chain comprising the amino acid sequence of SEQ ID NO: 94 and a light chain comprising the amino acid sequence of SEQ ID NO: 95.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 92, and/or (e.g., and) a light chain comprising an amino acid sequence that is at least 80% identical (e.g., 80%, 85%, 90%, 95%, 98%, or 99%) to SEQ ID NO: 95. In some embodiments, the humanized anti-TfR antibody of the present disclosure comprises a heavy chain comprising the amino acid sequence of SEQ ID NO: 92 and a light chain comprising the amino acid sequence of SEQ ID NO: 95.

In some embodiments, the anti-TfR antibody is a Fab fragment, Fab' fragment, or F(ab')2 fragment of an intact antibody (full-length antibody). Antigen binding fragment of an intact antibody (full-length antibody) can be prepared via routine methods (e.g., recombinantly or by digesting the heavy chain constant region of a full length IgG using an enzyme such as papain). For example, F(ab')2 fragments can be produced by pepsin or papain digestion of an antibody molecule, and Fab' fragments that can be generated by reducing the disulfide bridges of F(ab')2 fragments. In some embodiments, a heavy chain constant region in a Fab fragment of the anti-TfR1 antibody described herein comprises the amino acid sequence of:

(SEQ ID NO: 96)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHT

In some embodiments, the humanized anti-TfR antibody described herein comprises a heavy chain comprising any one of the VH as listed in Table 3 or any variants thereof and a heavy chain constant region that is at least 80%, at least 85%, at least 90%, at least 95%, or at least 99% identical to SEQ ID NO: 96. In some embodiments, the humanized anti-TfR antibody described herein comprises a heavy chain comprising any one of the VH as listed in Table 3 or any variants thereof and a heavy chain constant region that contains no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) as compared with SEQ ID NO: 96. In some embodiments, the humanized anti-TfR antibody described herein comprises a heavy chain comprising any one of the VH as listed in Table 3 or any variants thereof and a heavy chain constant region as set forth in SEQ ID NO: 96.

In some embodiments, the humanized anti-TfR antibody described herein comprises a light chain comprising any one of the VL as listed in Table 3 or any variants thereof and a light chain constant region that is at least 80%, at least 85%, at least 90%, at least 95%, or at least 99% identical to SEQ ID NO: 83. In some embodiments, the humanized anti-TfR antibody described herein comprises a light chain comprising any one of the VL as listed in Table 3 or any variants thereof and a light chain constant region contains no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) as compared with SEQ ID NO: 83. In some embodiments, the humanized anti-TfR antibody described herein comprises a light chain comprising any one of the VL as listed in Table 3 or any variants thereof and a light chain constant region set forth in SEQ ID NO: 83.

Examples of Fab heavy chain and light chain amino acid sequences of the anti-TfR antibodies described are provided in Table 5 below.

TABLE 5

Heavy chain and light chain sequences of examples of humanized anti-TfR Fabs

| Antibody | Fab Heavy Chain/Light Chain Sequences** |
| --- | --- |
| 3A4<br>VH3 (N54T*)/Vκ4 | Heavy Chain (with partial human IgG1 constant region)<br>EVQLVQSGSELKKPGASVKVSCTASGFNIKDDYMYWVRQPPGKGLEWIGWIDPE<br>TGDTEYASKFQDRVTVTADTSTNTAYMELSSLRSEDTAVYYCTLWLRRGLDYWG<br>QGTLVTVSSASTKGPSVFPLAPSSKSTSGGTAALGCLVKDYFPEPVTVSWNSGA<br>LTSGVHTFPAVLQSSGLYSLSSVVTVPSSSLGTQTYICNVNHKPSNTKVDKKVE<br>PKSCDKTHT (SEQ ID NO: 97)<br>Light Chain (with kappa light chain constant region)<br>DIVMTQSPLSLPVTPGEPASISCRSSKSLLHSNGYTYLFWFQQRPGQSPRLLIY<br>RMSNLASGVPDRFSGSGSGTDFTLKISRVEAEDVGVYYCMQHLEYPFTFGGGTK<br>VEIKRTVAAPSVFIFPPSDEQLKSGTASVVCLLNNFYPREAKVQWKVDNALQSG<br>NSQESVTEQDSKDSTYSLSSTLTLSKADYEKHKVYACEVTHQGLSSPVTKSFNR<br>GEC (SEQ ID NO: 85) |
| 3A4<br>VH3 (N54S*)/Vκ4 | Heavy Chain (with partial human IgG1 constant region)<br>EVQLVQSGSELKKPGASVKVSCTASGFNIKDDYMYWVRQPPGKGLEWIGWIDPE<br>SGDTEYASKFQDRVTVTADTSTNTAYMELSSLRSEDTAVYYCTLWLRRGLDYWG<br>QGTLVTVSSASTKGPSVFPLAPSSKSTSGGTAALGCLVKDYFPEPVTVSWNSGA<br>LTSGVHTFPAVLQSSGLYSLSSVVTVPSSSLGTQTYICNVNHKPSNTKVDKKVE<br>PKSCDKTHT (SEQ ID NO: 98)<br>Light Chain (with kappa light chain constant region)<br>DIVMTQSPLSLPVTPGEPASISCRSSKSLLHSNGYTYLFWFQQRPGQSPRLLIY<br>RMSNLASGVPDRFSGSGSGTDFTLKISRVEAEDVGVYYCMQHLEYPFTFGGGTK<br>VEIKRTVAAPSVFIFPPSDEQLKSGTASVVCLLNNFYPREAKVQWKVDNALQSG<br>NSQESVTEQDSKDSTYSLSSTLTLSKADYEKHKVYACEVTHQGLSSPVTKSFNR<br>GEC (SEQ ID NO: 85) |
| 3A4<br>VH3 /Vκ4 | Heavy Chain (with partial human IgG1 constant region)<br>EVQLVQSGSELKKPGASVKVSCTASGFNIKDDYMYWVRQPPGKGLEWIGWIDPE<br>NGDTEYASKFQDRVTVTADTSTNTAYMELSSLRSEDTAVYYCTLWLRRGLDYWG<br>QGTLVTVSSASTKGPSVFPLAPSSKSTSGGTAALGCLVKDYFPEPVTVSWNSGA<br>LTSGVHTFPAVLQSSGLYSLSSVVTVPSSSLGTQTYICNVNHKPSNTKVDKKVE<br>PKSCDKTHT (SEQ ID NO: 99)<br>Light Chain (with kappa light chain constant region)<br>DIVMTQSPLSLPVTPGEPASISCRSSKSLLHSNGYTYLFWFQQRPGQSPRLLIY<br>RMSNLASGVPDRFSGSGSGTDFTLKISRVEAEDVGVYYCMQHLEYPFTFGGGTK<br>VEIKRTVAAPSVFIFPPSDEQLKSGTASVVCLLNNFYPREAKVQWKVDNALQSG<br>NSQESVTEQDSKDSTYSLSSTLTLSKADYEKHKVYACEVTHQGLSSPVTKSFNR<br>GEC (SEQ ID NO: 85) |
| 3M12<br>VH3/Vκ2 | Heavy Chain (with partial human IgG1 constant region)<br>QVQLQESGPGLVKPSQTLSLTCSVTGYSITSGYYWNWIRQPPGKGLEWMGYITF<br>DGANNYNPSLKNRVSISRDTSKNQFSLKLSSVTAEDTATYYCTRSSYDYDVLDY<br>WGQGTTVTVSSASTKGPSVFPLAPSSKSTSGGTAALGCLVKDYFPEPVTVSWNS<br>GALTSGVHTFPAVLQSSGLYSLSSVVTVPSSSLGTQTYICNVNHKPSNTKVDKK<br>VEPKSCDKTHT (SEQ ID NO: 100)<br>Light Chain (with kappa light chain constant region)<br>DIQMTQSPSSLSASVGDRVTITCRASQDISNFLNWYQQKPGQPVKLLIYYTSRL<br>HSGVPSRFSGSGSGTDFTLTISSLQPEDFATYFCQQGHTLPYTFGQGTKLEIKR<br>TVAAPSVFIFPPSDEQLKSGTASVVCLLNNFYPREAKVQWKVDNALQSGNSQES<br>VTEQDSKDSTYSLSSTLTLSKADYEKHKVYACEVTHQGLSSPVTKSFNRGEC<br>(SEQ ID NO: 89) |
| 3M12<br>VH3/Vκ3 | Heavy Chain (with partial human IgG1 constant region)<br>QVQLQESGPGLVKPSQTLSLTCSVTGYSITSGYYWNWIRQPPGKGLEWMGYITF<br>DGANNYNPSLKNRVSISRDTSKNQFSLKLSSVTAEDTATYYCTRSSYDYDVLDY<br>WGQGTTVTVSSASTKGPSVFPLAPSSKSTSGGTAALGCLVKDYFPEPVTVSWNS<br>GALTSGVHTFPAVLQSSGLYSLSSVVTVPSSSLGTQTYICNVNHKPSNTKVDKK<br>VEPKSCDKTHT (SEQ ID NO: 100)<br>Light Chain (with kappa light chain constant region)<br>DIQMTQSPSSLSASVGDRVTITCRASQDISNFLNWYQQKPGQPVKLLIYYTSRL<br>HSGVPSRFSGSGSGTDFTLTISSLQPEDFATYFCQQGHTLPYTFGQGTKLEIKR<br>TVAAPSVFIFPPSDEQLKSGTASVVCLLNNFYPREAKVQWKVDNALQSGNSQES<br>VTEQDSKDSTYSLSSTLTLSKADYEKHKVYACEVTHQGLSSPVTKSFNRGEC<br>(SEQ ID NO: 90) |

TABLE 5-continued

Heavy chain and light chain sequences of examples of humanized anti-TfR Fabs

| Antibody | Fab Heavy Chain/Light Chain Sequences** |
|---|---|
| 3M12<br>VH4/Vκ2 | Heavy Chain (with partial human IgG1 constant region)<br>QVQLQESGPGLVKPSQTLSLTCTVTGYSITSGYYWNWIRQPPGKGLEWIGYITF<br>DGANNYNPSLKNRVSISRDTSKNQFSLKLSSVTAEDTATYYCTRSSYDYDVLDY<br>WGQGTTVTVSSASTKGPSVFPLAPSSKSTSGGTAALGCLVKDYFPEPVTVSWNS<br>GALTSGVHTFPAVLQSSGLYSLSSVVTVPSSSLGTQTYICNVNHKPSNTKVDKK<br>VEPKSCDKTHT (SEQ ID NO: 101)<br>Light Chain (with kappa light chain constant region)<br>DIQMTQSPSSLSASVGDRVTITCRASQDISNFLNWYQQKPGQPVKLLIYYTSRL<br>HSGVPSRFSGSGSGTDFTLTISSLQPEDFATYFCQQGHTLPYTFGQGTKLEIKR<br>TVAAPSVFIFPPSDEQLKSGTASVVCLLNNFYPREAKVQWKVDNALQSGNSQES<br>VTEQDSKDSTYSLSSTLTLSKADYEKHKVYACEVTHQGLSSPVTKSFNRGEC<br>(SEQ ID NO: 89) |
| 3M12<br>VH4/Vκ3 | Heavy Chain (with partial human IgG1 constant region)<br>QVQLQESGPGLVKPSQTLSLTCTVTGYSITSGYYWNWIRQPPGKGLEWIGYITF<br>DGANNYNPSLKNRVSISRDTSKNQFSLKLSSVTAEDTATYYCTRSSYDYDVLDY<br>WGQGTTVTVSSASTKGPSVFPLAPSSKSTSGGTAALGCLVKDYFPEPVTVSWNS<br>GALTSGVHTFPAVLQSSGLYSLSSVVTVPSSSLGTQTYICNVNHKPSNTKVDKK<br>VEPKSCDKTHT (SEQ ID NO: 101)<br>Light Chain (with kappa light chain constant region)<br>DIQMTQSPSSLSASVGDRVTITCRASQDISNFLNWYQQKPGQPVKLLIYYTSRL<br>HSGVPSRFSGSGSGTDFTLTISSLQPEDFATYYCQQGHTLPYTFGQGTKLEIKR<br>TVAAPSVFIFPPSDEQLKSGTASVVCLLNNFYPREAKVQWKVDNALQSGNSQES<br>VTEQDSKDSTYSLSSTLTLSKADYEKHKVYACEVTHQGLSSPVTKSFNRGEC<br>(SEQ ID NO: 90) |
| 5H12<br>VH5 (C33Y*)/Vκ3 | Heavy Chain (with partial human IgG1 constant region)<br>QVQLVQSGAEVKKPGASVKVSCKASGYSFTDYYINWVRQAPGQGLEWMGWIYPG<br>SGNTRYSERFKGRVTITRDTSASTAYMELSSLRSEDTAVYYCAREDYYPYHGMD<br>YWGQGTLVTVSSASTKGPSVFPLAPSSKSTSGGTAALGCLVKDYFPEPVTVSWN<br>SGALTSGVHTFPAVLQSSGLYSLSSVVTVPSSSLGTQTYICNVNHKPSNTKVDK<br>KVEPKSCDKTHT (SEQ ID NO: 102)<br>Light Chain (with kappa light chain constant region)<br>DIVLTQSPDSLAVSLGERATINCRASESVDGYDNSFMHWYQQKPGQPPKLLIFR<br>ASNLESGVPDRFSGSGSRTDFTLTISSLQAEDVAVYYCQQSSEDPWTFGQGTKL<br>EIKRTVAAPSVFIFPPSDEQLKSGTASVVCLLNNFYPREAKVQWKVDNALQSGN<br>SQESVTEQDSKDSTYSLSSTLTLSKADYEKHKVYACEVTHQGLSSPVTKSFNRG<br>EC (SEQ ID NO: 93) |
| 5H12<br>VH5 (C33D*)/Vκ4 | Heavy Chain (with partial human IgG1 constant region)<br>QVQLVQSGAEVKKPGASVKVSCKASGYSFTDYDINWVRQAPGQGLEWMGWIYPG<br>SGNTRYSERFKGRVTITRDTSASTAYMELSSLRSEDTAVYYCAREDYYPYHGMD<br>YWGQGTLVTVSSASTKGPSVFPLAPSSKSTSGGTAALGCLVKDYFPEPVTVSWN<br>SGALTSGVHTFPAVLQSSGLYSLSSVVTVPSSSLGTQTYICNVNHKPSNTKVDK<br>KVEPKSCDKTHT (SEQ ID NO: 103)<br>Light Chain (with kappa light chain constant region)<br>DIVMTQSPDSLAVSLGERATINCRASESVDGYDNSFMHWYQQKPGQPPKLLIFR<br>ASNLESGVPDRFSGSGSGTDFTLTISSLQAEDVAVYYCQQSSEDPWTFGQGTKL<br>EIKRTVAAPSVFIFPPSDEQLKSGTASVVCLLNNFYPREAKVQWKVDNALQSGN<br>SQESVTEQDSKDSTYSLSSTLTLSKADYEKHKVYACEVTHQGLSSPVTKSFNRG<br>EC (SEQ ID NO: 95) |
| 5H12<br>VH5 (C33Y*)/Vκ4 | Heavy Chain (with partial human IgG1 constant region)<br>QVQLVQSGAEVKKPGASVKVSCKASGYSFTDYYINWVRQAPGQGLEWMGWIYPG<br>SGNTRYSERFKGRVTITRDTSASTAYMELSSLRSEDTAVYYCAREDYYPYHGMD<br>YWGQGTLVTVSSASTKGPSVFPLAPSSKSTSGGTAALGCLVKDYFPEPVTVSWN<br>SGALTSGVHTFPAVLQSSGLYSLSSVVTVPSSSLGTQTYICNVNHKPSNTKVDK<br>KVEPKSCDKTHT (SEQ ID NO: 102)<br>Light Chain (with kappa light chain constant region)<br>DIVMTQSPDSLAVSLGERATINCRASESVDGYDNSFMHWYQQKPGQPPKLLIFR<br>ASNLESGVPDRFSGSGSGTDFTLTISSLQAEDVAVYYCQQSSEDPWTFGQGTKL<br>EIKRTVAAPSVFIFPPSDEQLKSGTASVVCLLNNFYPREAKVQWKVDNALQSGN<br>SQESVTEQDSKDSTYSLSSTLTLSKADYEKHKVYACEVTHQGLSSPVTKSFNRG<br>EC (SEQ ID NO: 95) |

*mutation positions are according to Kabat numbering of the respective VH sequences containing the mutations
**CDRs according to the Kabat numbering system are bolded; VH/VL sequences underlined In some embodiments, the humanized anti-TfR antibody of the present disclosure comprises a heavy chain containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) as compared with the heavy chain as set forth in any one of SEQ ID NOs: 97-103. Alternatively or in addition (e.g., in addition), the humanized anti-TfR antibody of the present disclosure comprises a light chain containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) as compared with the light chain as set forth in any one of SEQ ID NOs: 85, 89, 90, 93, and 95.

In some embodiments, the humanized anti-TfR antibody described herein comprises a heavy chain comprising an amino acid sequence that is at least 75% (e.g., 75%, 80%, 85%, 90%, 95%, 98%, or 99%) identical to any one of SEQ ID NOs: 97-103. Alternatively or in addition (e.g., in addition), the humanized anti-TfR antibody described herein comprises a light chain comprising an amino acid sequence that is at least 75% (e.g., 75%, 80%, 85%, 90%, 95%, 98%, or 99%) identical to any one of SEQ ID NOs: 85, 89, 90, 93, and 95. In some embodiments, the anti-TfR antibody described herein comprises a heavy chain comprising the amino acid sequence of any one of SEQ ID NOs: 97-103. Alternatively or in addition (e.g., in addition), the anti-TfR antibody described herein comprises a light chain comprising the amino acid sequence of any one of SEQ ID NOs: 85, 89, 90, 93, and 95.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 97, and/or (e.g., and) a light chain comprising an amino acid sequence that is at least 80% identical (e.g., 80%, 85%, 90%, 95%, 98%, or 99%) to SEQ ID NO: 85. In some embodiments, the humanized anti-TfR antibody of the present disclosure comprises a heavy chain comprising the amino acid sequence of SEQ ID NO: 97 and a light chain comprising the amino acid sequence of SEQ ID NO: 85.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 98, and/or (e.g., and) a light chain comprising an amino acid sequence that is at least 80% identical (e.g., 80%, 85%, 90%, 95%, 98%, or 99%) to SEQ ID NO: 85. In some embodiments, the humanized anti-TfR antibody of the present disclosure comprises a heavy chain comprising the amino acid sequence of SEQ ID NO: 98 and a light chain comprising the amino acid sequence of SEQ ID NO: 85.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 99, and/or (e.g., and) a light chain comprising an amino acid sequence that is at least 80% identical (e.g., 80%, 85%, 90%, 95%, 98%, or 99%) to SEQ ID NO: 85. In some embodiments, the humanized anti-TfR antibody of the present disclosure comprises a heavy chain comprising the amino acid sequence of SEQ ID NO: 99 and a light chain comprising the amino acid sequence of SEQ ID NO: 85.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 100, and/or (e.g., and) a light chain comprising an amino acid sequence that is at least 80% identical (e.g., 80%, 85%, 90%, 95%, 98%, or 99%) to SEQ ID NO: 89. In some embodiments, the humanized anti-TfR antibody of the present disclosure comprises a heavy chain comprising the amino acid sequence of SEQ ID NO: 100 and a light chain comprising the amino acid sequence of SEQ ID NO: 89.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 100, and/or (e.g., and) a light chain comprising an amino acid sequence that is at least 80% identical (e.g., 80%, 85%, 90%, 95%, 98%, or 99%) to SEQ ID NO: 90. In some embodiments, the humanized anti-TfR antibody of the present disclosure comprises a heavy chain comprising the amino acid sequence of SEQ ID NO: 100 and a light chain comprising the amino acid sequence of SEQ ID NO: 90.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 101, and/or (e.g., and) a light chain comprising an amino acid sequence that is at least 80% identical (e.g., 80%, 85%, 90%, 95%, 98%, or 99%) to SEQ ID NO: 89. In some embodiments, the humanized anti-TfR antibody of the present disclosure comprises a heavy chain comprising the amino acid sequence of SEQ ID NO: 101 and a light chain comprising the amino acid sequence of SEQ ID NO: 89.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 101, and/or (e.g., and) a light chain comprising an amino acid sequence that is at least 80% identical (e.g., 80%, 85%, 90%, 95%, 98%, or 99%) to SEQ ID NO: 90. In some embodiments, the humanized anti-TfR antibody of the present disclosure comprises a heavy chain comprising the amino acid sequence of SEQ ID NO: 101 and a light chain comprising the amino acid sequence of SEQ ID NO: 90.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 102, and/or (e.g., and) a light chain comprising an amino acid sequence that is at least 80% identical (e.g., 80%, 85%, 90%, 95%, 98%, or 99%) to SEQ ID NO: 93. In some embodiments, the humanized anti-TfR antibody of the present disclosure comprises a heavy chain comprising the amino acid sequence of SEQ ID NO: 102 and a light chain comprising the amino acid sequence of SEQ ID NO: 93.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 103, and/or (e.g., and) a light chain comprising an amino acid sequence that is at least 80% identical (e.g., 80%, 85%, 90%, 95%, 98%, or 99%) to SEQ ID NO: 95. In some embodiments, the humanized anti-TfR antibody of the present disclosure comprises a heavy chain comprising the amino acid sequence of SEQ ID NO: 103 and a light chain comprising the amino acid sequence of SEQ ID NO: 95.

In some embodiments, the humanized anti-TfR antibody of the present disclosure comprises a heavy chain comprising an amino acid sequence that is at least 80% (e.g., 80%, 85%, 90%, 95%, 98%, or 99%) identical to SEQ ID NO: 102, and/or (e.g., and) a light chain comprising an amino acid sequence that is at least 80% identical (e.g., 80%, 85%, 90%, 95%, 98%, or 99%) to SEQ ID NO: 95. In some embodiments, the humanized anti-TfR antibody of the present disclosure comprises a heavy chain comprising the amino acid sequence of SEQ ID NO: 102 and a light chain comprising the amino acid sequence of SEQ ID NO: 95.

In some embodiments, the humanized anti-TfR receptor antibodies described herein can be in any antibody form, including, but not limited to, intact (i.e., full-length) antibodies, antigen-binding fragments thereof (such as Fab, Fab', F(ab')2, Fv), single chain antibodies, bi-specific antibodies, or nanobodies. In some embodiments, humanized the anti-TfR antibody described herein is a scFv. In some embodiments, the humanized anti-TfR antibody described herein is a scFv-Fab (e.g., scFv fused to a portion of a constant region). In some embodiments, the anti-TfR receptor antibody described herein is a scFv fused to a constant region (e.g., human IgG1 constant region as set forth in SEQ ID NO: 81 or SEQ ID NO: 82, or a portion thereof such as the Fc portion) at either the N-terminus of C-terminus.

In some embodiments, conservative mutations can be introduced into antibody sequences (e.g., CDRs or framework sequences) at positions where the residues are not likely to be involved in interacting with a target antigen (e.g., transferrin receptor), for example, as determined based on a crystal structure. In some embodiments, one, two or more mutations (e.g., amino acid substitutions) are introduced into the Fc region of an anti-TfR antibody described herein (e.g., in a CH2 domain (residues 231-340 of human IgG1) and/or (e.g., and) CH3 domain (residues 341-447 of human IgG1) and/or (e.g., and) the hinge region, with numbering according to the Kabat numbering system (e.g., the EU index in Kabat)) to alter one or more functional properties of the antibody, such as serum half-life, complement fixation, Fc receptor binding and/or (e.g., and) antigen-dependent cellular cytotoxicity.

In some embodiments, one, two or more mutations (e.g., amino acid substitutions) are introduced into the hinge region of the Fc region (CH1 domain) such that the number of cysteine residues in the hinge region are altered (e.g., increased or decreased) as described in, e.g., U.S. Pat. No. 5,677,425. The number of cysteine residues in the hinge region of the CH1 domain can be altered to, e.g., facilitate assembly of the light and heavy chains, or to alter (e.g., increase or decrease) the stability of the antibody or to facilitate linker conjugation.

In some embodiments, one, two or more mutations (e.g., amino acid substitutions) are introduced into the Fc region of a muscle-targeting antibody described herein (e.g., in a CH2 domain (residues 231-340 of human IgG1) and/or (e.g., and) CH3 domain (residues 341-447 of human IgG1) and/or (e.g., and) the hinge region, with numbering according to the Kabat numbering system (e.g., the EU index in Kabat)) to increase or decrease the affinity of the antibody for an Fc receptor (e.g., an activated Fc receptor) on the surface of an effector cell. Mutations in the Fc region of an antibody that decrease or increase the affinity of an antibody for an Fc receptor and techniques for introducing such mutations into the Fc receptor or fragment thereof are known to one of skill in the art. Examples of mutations in the Fc receptor of an antibody that can be made to alter the affinity of the antibody for an Fc receptor are described in, e.g., Smith P et al., (2012) PNAS 109:6181-6186, U.S. Pat. No. 6,737,056, and International Publication Nos. WO 02/060919; WO 98/23289; and WO 97/34631, which are incorporated herein by reference.

In some embodiments, one, two or more amino acid mutations (i.e., substitutions, insertions or deletions) are introduced into an IgG constant domain, or FcRn-binding fragment thereof (preferably an Fc or hinge-Fc domain fragment) to alter (e.g., decrease or increase) half-life of the antibody in vivo. See, e.g., International Publication Nos. WO 02/060919; WO 98/23289; and WO 97/34631; and U.S. Pat. Nos. 5,869,046, 6,121,022, 6,277,375 and 6,165,745 for examples of mutations that will alter (e.g., decrease or increase) the half-life of an antibody in vivo.

In some embodiments, one, two or more amino acid mutations (i.e., substitutions, insertions or deletions) are introduced into an IgG constant domain, or FcRn-binding fragment thereof (preferably an Fc or hinge-Fc domain fragment) to decrease the half-life of the anti-anti-TfR antibody in vivo. In some embodiments, one, two or more amino acid mutations (i.e., substitutions, insertions or deletions) are introduced into an IgG constant domain, or FcRn-binding fragment thereof (preferably an Fc or hinge-Fc domain fragment) to increase the half-life of the antibody in vivo. In some embodiments, the antibodies can have one or more amino acid mutations (e.g., substitutions) in the second constant (CH2) domain (residues 231-340 of human IgG1) and/or (e.g., and) the third constant (CH3) domain (residues 341-447 of human IgG1), with numbering according to the EU index in Kabat (Kabat E A et al., (1991) supra). In some embodiments, the constant region of the IgG1 of an antibody described herein comprises a methionine (M) to tyrosine (Y) substitution in position 252, a serine(S) to threonine (T) substitution in position 254, and a threonine (T) to glutamic acid (E) substitution in position 256, numbered according to the EU index as in Kabat. Sec U.S. Pat. No. 7,658,921, which is incorporated herein by reference. This type of mutant IgG, referred to as "YTE mutant" has been shown to display fourfold increased half-life as compared to wild-type versions of the same antibody (see Dall'Acqua W F et al., (2006) J Biol Chem 281:23514-24). In some embodiments, an antibody comprises an IgG constant domain comprising one, two, three or more amino acid substitutions of amino acid residues at positions 251-257, 285-290, 308-314, 385-389, and 428-436, numbered according to the EU index as in Kabat.

In some embodiments, one, two or more amino acid substitutions are introduced into an IgG constant domain Fc region to alter the effector function(s) of the anti-anti-TfR antibody. The effector ligand to which affinity is altered can be, for example, an Fc receptor or the C1 component of complement. This approach is described in further detail in U.S. Pat. Nos. 5,624,821 and 5,648,260. In some embodiments, the deletion or inactivation (through point mutations or other means) of a constant region domain can reduce Fc receptor binding of the circulating antibody thereby increasing tumor localization. Sec, e.g., U.S. Pat. Nos. 5,585,097 and 8,591,886 for a description of mutations that delete or inactivate the constant domain and thereby increase tumor localization. In some embodiments, one or more amino acid substitutions may be introduced into the Fc region of an antibody described herein to remove potential glycosylation sites on Fc region, which may reduce Fc receptor binding (see, e.g., Shields R L et al., (2001) J Biol Chem 276:6591-604).

In some embodiments, one or more amino in the constant region of an anti-TfR antibody described herein can be replaced with a different amino acid residue such that the antibody has altered C1q binding and/or (e.g., and) reduced or abolished complement dependent cytotoxicity (CDC). This approach is described in further detail in U.S. Pat. No. 6,194,551 (Idusogie et al). In some embodiments, one or more amino acid residues in the N-terminal region of the CH2 domain of an antibody described herein are altered to thereby alter the ability of the antibody to fix complement. This approach is described further in International Publication No. WO 94/29351. In some embodiments, the Fc region of an antibody described herein is modified to increase the ability of the antibody to mediate antibody dependent cellular cytotoxicity (ADCC) and/or (e.g., and) to increase the affinity of the antibody for an Fcγ receptor. This approach is described further in International Publication No. WO 00/42072.

In some embodiments, the heavy and/or (e.g., and) light chain variable domain(s) sequence(s) of the antibodies provided herein can be used to generate, for example, CDR-grafted, chimeric, humanized, or composite human antibodies or antigen-binding fragments, as described elsewhere herein. As understood by one of ordinary skill in the art, any variant, CDR-grafted, chimeric, humanized, or composite antibodies derived from any of the antibodies provided herein may be useful in the compositions and methods described herein and will maintain the ability to specifically bind transferrin receptor, such that the variant, CDR-grafted, chimeric, humanized, or composite antibody has at least 50%, at least 60%, at least 70%, at least 80%, at least 90%, at least 95% or more binding to transferrin receptor relative to the original antibody from which it is derived.

In some embodiments, the antibodies provided herein comprise mutations that confer desirable properties to the antibodies. For example, to avoid potential complications due to Fab-arm exchange, which is known to occur with native IgG4 mAbs, the antibodies provided herein may comprise a stabilizing 'Adair' mutation (Angal S., et al., "A single amino acid substitution abolishes the heterogeneity of chimeric mouse/human (IgG4) antibody," Mol Immunol 30, 105-108; 1993), where serine 228 (EU numbering; residue 241 Kabat numbering) is converted to proline resulting in an IgG1-like hinge sequence. Accordingly, any of the antibodies may include a stabilizing 'Adair' mutation.

In some embodiments, an antibody is modified, e.g., modified via glycosylation, phosphorylation, sumoylation, and/or (e.g., and) methylation. In some embodiments, an antibody is a glycosylated antibody, which is conjugated to one or more sugar or carbohydrate molecules. In some embodiments, the one or more sugar or carbohydrate molecule are conjugated to the antibody via N-glycosylation, O-glycosylation, C-glycosylation, glypiation (GPI anchor attachment), and/or (e.g., and) phosphoglycosylation. In some embodiments, the one or more sugar or carbohydrate molecules are monosaccharides, disaccharides, oligosaccharides, or glycans. In some embodiments, the one or more sugar or carbohydrate molecule is a branched oligosaccharide or a branched glycan. In some embodiments, the one or more sugar or carbohydrate molecule includes a mannose unit, a glucose unit, an N-acetylglucosamine unit, an N-acetylgalactosamine unit, a galactose unit, a fucose unit, or a phospholipid unit. In some embodiments, there are about 1-10, about 1-5, about 5-10, about 1-4, about 1-3, or about 2 sugar molecules. In some embodiments, a glycosylated antibody is fully or partially glycosylated. In some embodiments, an antibody is glycosylated by chemical reactions or by enzymatic means. In some embodiments, an antibody is glycosylated in vitro or inside a cell, which may optionally be deficient in an enzyme in the N- or O-glycosylation pathway, e.g. a glycosyltransferase. In some embodiments, an antibody is functionalized with sugar or carbohydrate molecules as described in International Patent Application Publication WO2014065661, published on May 1, 2014, entitled, "Modified antibody, antibody-conjugate and process for the preparation thereof".

In some embodiments, any one of the anti-TfR1 antibodies described herein may comprise a signal peptide in the heavy and/or (e.g., and) light chain sequence (e.g., a N-terminal signal peptide). In some embodiments, the anti-TfR1 antibody described herein comprises any one of the VH and VL sequences, any one of the IgG heavy chain and light chain sequences, or any one of the Fab heavy chain and light chain sequences described herein, and further comprises a signal peptide (e.g., a N-terminal signal peptide). In some embodiments, the signal peptide comprises the amino acid sequence of MGWSCIILFLVATATGVHS (SEQ ID NO: 104).

Other Known Anti-Transferrin Receptor Antibodies

Any other appropriate anti-transferrin receptor antibodies known in the art may be used as the muscle-targeting agent in the complexes disclosed herein. Examples of known anti-transferrin receptor antibodies, including associated references and binding epitopes, are listed in Table 8. In some embodiments, the anti-transferrin receptor antibody comprises the complementarity determining regions (CDR-H1, CDR-H2, CDR-H3, CDR-L1, CDR-L2, and CDR-L3) of any of the anti-transferrin receptor antibodies provided herein, e.g., anti-transferrin receptor antibodies listed in Table 8.

TABLE 8

List of anti-transferrin receptor antibody clones, including associated references and binding epitope information.

| Antibody Clone Name | Reference(s) | Epitope/Notes |
|---|---|---|
| OKT9 | U.S. Pat. No. 4,364,934, filed Dec. 4, 1979, entitled "MONOCLONAL ANTIBODY TO A HUMAN EARLY THYMOCYTE ANTIGEN AND METHODS FOR PREPARING SAME" Schneider C. et al. "Structural features of the cell surface receptor for transferrin that is recognized by the monoclonal antibody OKT9." J Biol Chem. 1982, 257: 14, 8516-8522. | Apical domain of TfR (residues 305-366 of human TfR sequence XM_052730.3, available in GenBank) |

TABLE 8-continued

List of anti-transferrin receptor antibody clones, including associated references and binding epitope information.

| | | |
|---|---|---|
| (From JCR) Clone M11 Clone M23 Clone M27 Clone B84 | WO 2015/098989, filed Dec. 24, 2014, "Novel anti-Transferrin receptor antibody that passes through blood-brain barrier" U.S. Pat. No. 9,994,641, filed Dec. 24, 2014, "Novel anti-Transferrin receptor antibody that passes through blood-brain barrier" | Apical domain (residues 230-244 and 326-347 of TfR) and protease-like domain (residues 461-473) |
| (From Genentech) 7A4, 8A2, 15D2, 10D11, 7B10, 15G11, 16G5, 13C3, 16G4, 16F6, 7G7, 4C2, 1B12, and 13D4 | WO 2016/081643, filed May 26, 2016, entitled "ANTI-TRANSFERRIN RECEPTOR ANTIBODIES AND METHODS OF USE" U.S. Pat. No. 9,708,406, filed May 20, 2014, "Anti-transferrin receptor antibodies and methods of use" | Apical domain and non-apical regions |
| (From Armagen) 8D3 | Lee et al. "Targeting Rat Anti-Mouse Transferrin Receptor Monoclonal Antibodies through Blood-Brain Barrier in Mouse" 2000, J Pharmacol. Exp. Ther., 292: 1048-1052. US Patent App. 2010/077498, filed Sep. 11, 2008, entitled "COMPOSITIONS AND METHODS FOR BLOOD-BRAIN BARRIER DELIVERY IN THE MOUSE" | |
| OX26 | Haobam, B. et al. 2014. Rab17-mediated recycling endosomes contribute to autophagosome formation in response to Group A *Streptococcus* invasion. Cellular microbiology. 16: 1806-21. | |
| DF1513 | Ortiz-Zapater E et al. Trafficking of the human transferrin receptor in plant cells: effects of tyrphostin A23 and brefeldin A. Plant J 48: 757-70 (2006). | |
| 1A1B2, 66IG10, MEM-189, JF0956, 29806, 1A1B2, TFRC/1818, 1E6, 66Ig10, TFRC/1059, Q1/71, 23D10, 13E4, TFRC/1149, ER-MP21, YTA74.4, BU54, 2B6, RI7 217 | Commercially available anti-transferrin receptor antibodies. | Novus Biologicals 8100 Southpark Way, A-8 Littleton CO 80120 |
| (From INSERM) BA120g | US Patent App. 2011/0311544A1, filed Jun. 15, 2005, entitled "ANTI-CD71 MONOCLONAL ANTIBODIES AND USES THEREOF FOR TREATING MALIGNANT TUMOR CELLS" | Does not compete with OKT9 |
| LUCA31 | U.S. Pat. No. 7,572,895, filed Jun. 7, 2004, entitled "TRANSFERRIN RECEPTOR ANTIBODIES" | "LUCA31 epitope" |
| (Salk Institute) B3/25 T58/30 | Trowbridge, I. S. et al. "Anti-transferrin receptor monoclonal antibody and toxin-antibody conjugates affect growth of human tumour cells." Nature, 1981, volume 294, pages 171-173 | |
| R17 217.1.3, 5E9C11, OKT9 (BE0023 clone) | Commercially available anti-transferrin receptor antibodies. | BioXcell 10 Technology Dr., Suite 2B West Lebanon, NH 03784-1671 USA |
| BK19.9, B3/25, T56/14 and T58/1 | Gatter, K. C. et al. "Transferrin receptors in human tissues: their distribution and possible clinical relevance." J Clin Pathol. 1983 May; 36(5): 539-45. | |

TABLE 8-continued

List of anti-transferrin receptor antibody clones, including associated references and binding epitope information.

| Anti-TfR antibody | | Additional Anti-TfR SEQ ID NOs | | | |
|---|---|---|---|---|---|
| | | VH/VL | CDR1 | CDR2 | CDR3 |
| CDRH1 (SEQ ID NO: 2265) | VH1 | 2280 | 2273 | 2274 | 2267 |
| CDRH2 (SEQ ID NO: 2266) | VH2 | 2281 | 2273 | 2275 | 2267 |
| CDRH3 (SEQ ID NO: 2267) | VH3 | 2282 | 2273 | 2276 | 2267 |
| CDRL1 (SEQ ID NO: 2268) | VH4 | 2283 | 2273 | 2275 | 2267 |
| CDRL2 (SEQ ID NO: 2269) | VL1 | 2284 | 2268 | 2269 | 115 |
| CDRL3 (SEQ ID NO: 2270) | VL2 | 2285 | 2268 | 2269 | 115 |
| VH (SEQ ID NO: 2271) | VL3 | 2286 | 2268 | 2277 | 2270 |
| VL (SEQ ID NO: 2272) | VL4 | 2287 | 2278 | 2279 | 2270 |

In some embodiments, transferrin receptor antibodies of the present disclosure include one or more of the CDR-H (e.g., CDR-H1, CDR-H2, and CDR-H3) amino acid sequences from any one of the anti-transferrin receptor antibodies selected from Table 8. In some embodiments, transferrin receptor antibodies include the CDR-H1, CDR-H2, and CDR-H3 as provided for any one of the anti-transferrin receptor antibodies selected from Table 8. In some embodiments, anti-transferrin receptor antibodies include the CDR-L1, CDR-L2, and CDR-L3 as provided for any one of the anti-transferrin receptor antibodies selected from Table 8. In some embodiments, anti-transferrin antibodies include the CDR-H1, CDR-H2, CDR-H3, CDR-L1, CDR-L2, and CDR-L3 as provided for any one of the anti-transferrin receptor antibodies selected from Table 8. The disclosure also includes any nucleic acid sequence that encodes a molecule comprising a CDR-H1, CDR-H2, CDR-H3, CDR-L1, CDR-L2, or CDR-L3 as provided for any one of the anti-transferrin receptor antibodies selected from Table 8. In some embodiments, antibody heavy and light chain CDR3 domains may play a particularly important role in the binding specificity/affinity of an antibody for an antigen. Accordingly, anti-transferrin receptor antibodies of the disclosure may include at least the heavy and/or (e.g., and) light chain CDR3s of any one of the anti-transferrin receptor antibodies selected from Table 8.

In some examples, any of the anti-transferrin receptor antibodies of the disclosure have one or more CDR (e.g., CDR-H or CDR-L) sequences substantially similar to any of the CDR-H1, CDR-H2, CDR-H3, CDR-L1, CDR-L2, and/or (e.g., and) CDR-L3 sequences from one of the anti-transferrin receptor antibodies selected from Table 8. In some embodiments, the position of one or more CDRs along the VH (e.g., CDR-H1, CDR-H2, or CDR-H3) and/or (e.g., and) VL (e.g., CDR-L1, CDR-L2, or CDR-L3) region of an antibody described herein can vary by one, two, three, four, five, or six amino acid positions so long as immunospecific binding to transferrin receptor (e.g., human transferrin receptor) is maintained (e.g., substantially maintained, for example, at least 50%, at least 60%, at least 70%, at least 80%, at least 90%, at least 95% of the binding of the original antibody from which it is derived). For example, in some embodiments, the position defining a CDR of any antibody described herein can vary by shifting the N-terminal and/or (e.g., and) C-terminal boundary of the CDR by one, two, three, four, five, or six amino acids, relative to the CDR position of any one of the antibodies described herein, so long as immunospecific binding to transferrin receptor (e.g., human transferrin receptor) is maintained (e.g., substantially maintained, for example, at least 50%, at least 60%, at least 70%, at least 80%, at least 90%, at least 95% of the binding of the original antibody from which it is derived). In another embodiment, the length of one or more CDRs along the VH (e.g., CDR-H1, CDR-H2, or CDR-H3) and/or (e.g., and) VL (e.g., CDR-L1, CDR-L2, or CDR-L3) region of an antibody described herein can vary (e.g., be shorter or longer) by one, two, three, four, five, or more amino acids, so long as immunospecific binding to transferrin receptor (e.g., human transferrin receptor) is maintained (e.g., substantially maintained, for example, at least 50%, at least 60%, at least 70%, at least 80%, at least 90%, at least 95% of the binding of the original antibody from which it is derived).

Accordingly, in some embodiments, a CDR-L1, CDR-L2, CDR-L3, CDR-H1, CDR-H2, and/or (e.g., and) CDR-H3 described herein may be one, two, three, four, five or more amino acids shorter than one or more of the CDRs described herein (e.g., CDRS from any of the anti-transferrin receptor antibodies selected from Table 8) so long as immunospecific binding to transferrin receptor (e.g., human transferrin receptor) is maintained (e.g., substantially maintained, for example, at least 50%, at least 60%, at least 70%, at least 80%, at least 90%, at least 95% relative to the binding of the original antibody from which it is derived). In some embodiments, a CDR-L1, CDR-L2, CDR-L3, CDR-H1, CDR-H2, and/or (e.g., and) CDR-H3 described herein may be one, two, three, four, five or more amino acids longer than one or more of the CDRs described herein (e.g., CDRS from any of the anti-transferrin receptor antibodies selected from Table 8) so long as immunospecific binding to transferrin receptor (e.g., human transferrin receptor) is maintained (e.g., substantially maintained, for example, at least 50%, at least 60%, at least 70%, at least 80%, at least 90%, at least 95% relative to the binding of the original antibody from which it is derived). In some embodiments, the amino portion of a CDR-L1, CDR-L2, CDR-L3, CDR-H1, CDR-H2, and/or (e.g., and) CDR-H3 described herein can be extended by one, two, three, four, five or more amino acids compared to one or more of the CDRs described herein (e.g., CDRS from any of the anti-transferrin receptor antibodies selected from Table 8) so long as immunospecific binding to transferrin receptor (e.g., human transferrin receptor is maintained (e.g., substantially maintained, for example, at least 50%, at least 60%, at least 70%, at least 80%, at least 90%, at least 95% relative to the binding of the original antibody from which it is derived). In some embodiments, the carboxy portion of a CDR-L1, CDR-L2, CDR-L3, CDR-H1, CDR-H2, and/or (e.g., and) CDR-H3 described herein can be extended by one, two, three, four, five or more amino acids compared to one or more of the CDRs described herein (e.g., CDRS from any of the anti-transferrin receptor antibodies selected from Table 8) so long as immunospecific binding to transferrin receptor (e.g., human transferrin receptor) is maintained (e.g., substantially maintained, for example, at least 50%, at least 60%, at least 70%, at least 80%, at least 90%, at least 95% relative to the binding of the original antibody from which it is derived). In some embodiments, the amino portion of a CDR-L1, CDR-L2, CDR-L3, CDR-H1, CDR-H2, and/or (e.g., and) CDR-H3 described herein can be shortened by one, two, three, four, five or more amino acids compared to one or more of the CDRs described herein (e.g., CDRS from any of the anti-transferrin receptor antibodies selected from Table 8) so long as immunospecific binding to transferrin receptor (e.g., human transferrin receptor) is maintained (e.g., substantially maintained, for example, at least 50%, at least 60%, at least 70%, at least 80%, at least 90%, at least 95% relative to the binding of the original antibody from which it is derived). In some embodiments, the carboxy portion of a CDR-L1, CDR-L2, CDR-L3, CDR-H1, CDR-H2, and/or (e.g., and) CDR-H3 described herein can be shortened by one, two, three, four, five or more amino acids compared to one or more of the CDRs described herein (e.g., CDRS from any of the anti-transferrin receptor antibodies selected from Table 8) so long as immunospecific binding to transferrin receptor (e.g., human transferrin receptor) is maintained (e.g., substantially maintained, for example, at least 50%, at least 60%, at least 70%, at least 80%, at least 90%, at least 95% relative to the binding of the original antibody from which it is derived). Any method can be used to ascertain whether immunospecific binding to transferrin receptor (e.g., human transferrin receptor) is maintained, for example, using binding assays and conditions described in the art.

In some examples, any of the anti-transferrin receptor antibodies of the disclosure have one or more CDR (e.g., CDR-H or CDR-L) sequences substantially similar to any one of the anti-transferrin receptor antibodies selected from Table 8. For example, the antibodies may include one or more CDR sequence(s) from any of the anti-transferrin receptor antibodies selected from Table 8 containing up to 5, 4, 3, 2, or 1 amino acid residue variations as compared to the corresponding CDR region in any one of the CDRs provided herein (e.g., CDRs from any of the anti-transferrin receptor antibodies selected from Table 8) so long as immunospecific binding to transferrin receptor (e.g., human transferrin receptor) is maintained (e.g., substantially maintained, for example, at least 50%, at least 60%, at least 70%, at least 80%, at least 90%, at least 95% relative to the binding of the original antibody from which it is derived). In some embodiments, any of the amino acid variations in any of the CDRs provided herein may be conservative variations. Conservative variations can be introduced into the CDRs at positions where the residues are not likely to be involved in interacting with a transferrin receptor protein (e.g., a human transferrin receptor protein), for example, as determined based on a crystal structure. Some aspects of the disclosure provide transferrin receptor antibodies that comprise one or more of the heavy chain variable (VH) and/or (e.g., and) light chain variable (VL) domains provided herein. In some embodiments, any of the VH domains provided herein include one or more of the CDR-H sequences (e.g., CDR-H1, CDR-H2, and CDR-H3) provided herein, for example, any of the CDR-H sequences provided in any one of the anti-transferrin receptor antibodies selected from Table 8. In some embodiments, any of the VL domains provided herein include one or more of the CDR-L sequences (e.g., CDR-L1, CDR-L2, and CDR-L3) provided herein, for example, any of the CDR-L sequences provided in any one of the anti-transferrin receptor antibodies selected from Table 8.

In some embodiments, anti-transferrin receptor antibodies of the disclosure include any antibody that includes a heavy chain variable domain and/or (e.g., and) a light chain variable domain of any anti-transferrin receptor antibody, such as any one of the anti-transferrin receptor antibodies selected from Table 8. In some embodiments, anti-transferrin receptor antibodies of the disclosure include any antibody that includes the heavy chain variable and light chain variable pairs of any anti-transferrin receptor antibody, such as any one of the anti-transferrin receptor antibodies selected from Table 8.

Aspects of the disclosure provide anti-transferrin receptor antibodies having a heavy chain variable (VH) and/or (e.g., and) a light chain variable (VL) domain amino acid sequence homologous to any of those described herein. In some embodiments, the anti-transferrin receptor antibody comprises a heavy chain variable sequence or a light chain variable sequence that is at least 75% (e.g., 80%, 85%, 90%, 95%, 98%, or 99%) identical to the heavy chain variable sequence and/or any light chain variable sequence of any anti-transferrin receptor antibody, such as any one of the anti-transferrin receptor antibodies selected from Table 8. In some embodiments, the homologous heavy chain variable and/or (e.g., and) a light chain variable amino acid sequences do not vary within any of the CDR sequences provided herein. For example, in some embodiments, the degree of sequence variation (e.g., 75%, 80%, 85%, 90%, 95%, 98%, or 99%) may occur within a heavy chain variable and/or (e.g., and) a light chain variable sequence excluding any of the CDR sequences provided herein. In some embodiments, any of the anti-transferrin receptor antibodies provided herein comprise a heavy chain variable sequence and a light chain variable sequence that comprises a framework sequence that is at least 75%, 80%, 85%, 90%, 95%, 98%, or 99% identical to the framework sequence of any anti-transferrin receptor antibody, such as any one of the anti-transferrin receptor antibodies selected from Table 8.

In some embodiments, an anti-transferrin receptor antibody, which specifically binds to transferrin receptor (e.g., human transferrin receptor), comprises a light chain variable VL domain comprising any of the CDR-L domains (CDR-L1, CDR-L2, and CDR-L3), or CDR-L domain variants provided herein, of any of the anti-transferrin receptor antibodies selected from Table 8. In some embodiments, an anti-transferrin receptor antibody, which specifically binds to transferrin receptor (e.g., human transferrin receptor), comprises a light chain variable VL domain comprising the CDR-L1, the CDR-L2, and the CDR-L3 of any anti-transferrin receptor antibody, such as any one of the anti-transferrin receptor antibodies selected from Table 8. In some embodiments, the anti-transferrin receptor antibody comprises a light chain variable (VL) region sequence comprising one, two, three or four of the framework regions of the light chain variable region sequence of any anti-transferrin receptor antibody, such as any one of the anti-transferrin receptor antibodies selected from Table 8. In some embodiments, the anti-transferrin receptor antibody comprises one, two, three or four of the framework regions of a light chain variable region sequence which is at least 75%, 80%, 85%, 90%, 95%, or 100% identical to one, two, three or four of the framework regions of the light chain variable region sequence of any anti-transferrin receptor antibody, such as any one of the anti-transferrin receptor antibodies selected from Table 8. In some embodiments, the light chain variable framework region that is derived from said amino acid sequence consists of said amino acid sequence but for the presence of up to 10 amino acid substitutions, deletions, and/or (e.g., and) insertions, preferably up to 10 amino acid substitutions. In some embodiments, the light chain variable framework region that is derived from said amino acid sequence consists of said amino acid sequence with 1, 2, 3, 4, 5, 6, 7, 8, 9 or 10 amino acid residues being substituted for an amino acid found in an analogous position in a corresponding non-human, primate, or human light chain variable framework region.

In some embodiments, an anti-transferrin receptor antibody that specifically binds to transferrin receptor comprises the CDR-L1, the CDR-L2, and the CDR-L3 of any anti-transferrin receptor antibody, such as any one of the anti-transferrin receptor antibodies selected from Table 8. In some embodiments, the antibody further comprises one, two, three or all four VL framework regions derived from the VL of a human or primate antibody. The primate or human light chain framework region of the antibody selected for use with the light chain CDR sequences described herein, can have, for example, at least 70% (e.g., at least 75%, 80%, 85%, 90%, 95%, 98%, or at least 99%) identity with a light chain framework region of a non-human parent antibody. The primate or human light chain selected can have the same or substantially the same number of amino acids in its light chain complementarity determining regions to that of the light chain complementarity determining regions of any of the antibodies provided herein, e.g., any of the anti-transferrin receptor antibodies selected from Table 8. In some embodiments, the primate or human light chain framework region amino acid residues are from a natural primate or human antibody light chain framework region having at least 75% identity, at least 80% identity, at least 85% identity, at least 90% identity, at least 95% identity, at least 98% identity, at least 99% (or more) identity with the light chain framework regions of any anti-transferrin receptor antibody, such as any one of the anti-transferrin receptor antibodies selected from Table 8. In some embodiments, an anti-transferrin receptor antibody further comprises one, two, three or all four VL framework regions derived from a human light chain variable kappa subfamily. In some embodiments, an anti-transferrin receptor antibody further comprises one, two, three or all four VL framework regions derived from a human light chain variable lambda subfamily.

In some embodiments, any of the anti-transferrin receptor antibodies provided herein comprise a light chain variable domain that further comprises a light chain constant region. In some embodiments, the light chain constant region is a kappa, or a lambda light chain constant region. In some embodiments, the kappa or lambda light chain constant region is from a mammal, e.g., from a human, monkey, rat, or mouse. In some embodiments, the light chain constant region is a human kappa light chain constant region. In some embodiments, the light chain constant region is a human lambda light chain constant region. It should be appreciated that any of the light chain constant regions provided herein may be variants of any of the light chain constant regions provided herein. In some embodiments, the light chain constant region comprises an amino acid sequence that is at least 75%, 80%, 85%, 90%, 95%, 98%, or 99% identical to any of the light chain constant regions of any anti-transferrin receptor antibody, such as any one of the anti-transferrin receptor antibodies selected from Table 8.

In some embodiments, the anti-transferrin receptor antibody is any anti-transferrin receptor antibody, such as any one of the anti-transferrin receptor antibodies selected from Table 8.

In some embodiments, an anti-transferrin receptor antibody comprises a VL domain comprising the amino acid sequence of any anti-transferrin receptor antibody, such as any one of the anti-transferrin receptor antibodies selected from Table 8, and wherein the constant regions comprise the amino acid sequences of the constant regions of an IgG, IgE, IgM, IgD, IgA or IgY immunoglobulin molecule, or a human IgG, IgE, IgM, IgD, IgA or IgY immunoglobulin molecule. In some embodiments, an anti-transferrin receptor antibody comprises any of the VL domains, or VL domain variants, and any of the VH domains, or VH domain variants, wherein the VL and VH domains, or variants thereof, are from the same antibody clone, and wherein the constant regions comprise the amino acid sequences of the constant regions of an IgG, IgE, IgM, IgD, IgA or IgY immunoglobulin molecule, any class (e.g., IgG1, IgG2, IgG3, IgG4, IgA1 and IgA2), or any subclass (e.g., IgG2a and IgG2b) of immunoglobulin molecule. Non-limiting examples of human constant regions are described in the art, e.g., see Kabat E A et al., (1991) supra.

In some embodiments, the muscle-targeting agent is a transferrin receptor antibody (e.g., the antibody and variants thereof as described in International Application Publication WO 2016/081643, incorporated herein by reference).

The heavy chain and light chain CDRs of the antibody according to different definition systems are provided in Table 9. The different definition systems, e.g., the Kabat definition, the Chothia definition, and/or (e.g., and) the contact definition have been described. See, e.g., (e.g., Kabat, E. A., et al. (1991) Sequences of Proteins of Immunological Interest, Fifth Edition, U.S. Department of Health and Human Services, NIH Publication No. 91-3242, Chothia et al., (1989) Nature 342:877; Chothia, C. et al. (1987) J. Mol. Biol. 196:901-917, Al-lazikani et al (1997) J. Molec. Biol. 273:927-948; and Almagro, J. Mol. Recognit. 17:132-143 (2004). See also hgmp.mrc.ac.uk and bioinf.org.uk/abs).

TABLE 9

Heavy chain and light chain CDRs of a mouse transferrin receptor antibody

| CDRs | Kabat | Chothia | Contact |
|---|---|---|---|
| CDR-H1 | SYWMH (SEQ ID NO: 110) | GYTFTSY (SEQ ID NO: 116) | TSYWMH (SEQ ID NO: 118) |
| CDR-H2 | EINPTNGRTNYIEKFKS (SEQ ID NO: 111) | NPTNGR (SEQ ID NO: 117) | WIGEINPTNGRTN (SEQ ID NO: 119) |
| CDR-H3 | GTRAYHY (SEQ ID NO: 112) | GTRAYHY (SEQ ID NO: 112) | ARGTRA (SEQ ID NO: 120) |

TABLE 9-continued

Heavy chain and light chain CDRs of a mouse transferrin receptor antibody

| CDRs | Kabat | Chothia | Contact |
|---|---|---|---|
| CDR-L1 | RASDNLYSNLA (SEQ ID NO: 113) | RASDNLYSNLA (SEQ ID NO: 113) | YSNLAWY (SEQ ID NO: 121) |
| CDR-L2 | DATNLAD (SEQ ID NO: 114) | DATNLAD (SEQ ID NO: 114) | LLVYDATNLA (SEQ ID NO: 122) |
| CDR-L3 | QHFWGTPLT (SEQ ID NO: 115) | QHFWGTPLT (SEQ ID NO: 115) | QHFWGTPL (SEQ ID NO: 123) |

The heavy chain variable domain (VH) and light chain variable domain sequences are also provided:

VH
(SEQ ID NO: 124)
QVQLQQPGAELVKPGASVKLSCKASGYTFTSYWMHWVKQRPGQGLEWIGE

INPTNGRTNYIEKFKSKATLTVDKSSSTAYMQLSSLTSEDSAVYYCARGT

RAYHYWGQGTSVTVSS

VL
(SEQ ID NO: 125)
DIQMTQSPASLSVSVGETVTITCRASDNLYSNLAWYQQKQGKSPQLLVYD

ATNLADGVPSRFSGSGSGTQYSLKINSLQSEDFGTYYCQHFWGTPLTFGA

GTKLELK

In some embodiments, the transferrin receptor antibody of the present disclosure comprises a CDR-H1, a CDR-H2, and a CDR-H3 that are the same as the CDR-H1, CDR-H2, and CDR-H3 shown in Table 9. Alternatively or in addition (e.g., in addition), the transferrin receptor antibody of the present disclosure comprises a CDR-L1, a CDR-L2, and a CDR-L3 that are the same as the CDR-L1, CDR-L2, and CDR-L3 shown in Table 9.

In some embodiments, the transferrin receptor antibody of the present disclosure comprises a CDR-H1, a CDR-H2, and a CDR-H3, which collectively contains no more than 5 amino acid variations (e.g., no more than 5, 4, 3, 2, or 1 amino acid variation) as compared with the CDR-H1, CDR-H2, and CDR-H3 as shown in Table 9. "Collectively" means that the total number of amino acid variations in all of the three heavy chain CDRs is within the defined range. Alternatively or in addition (e.g., in addition), the transferrin receptor antibody of the present disclosure may comprise a CDR-L1, a CDR-L2, and a CDR-L3, which collectively contains no more than 5 amino acid variations (e.g., no more than 5, 4, 3, 2 or 1 amino acid variation) as compared with the CDR-L1, CDR-L2, and CDR-L3 as shown in Table 9.

In some embodiments, the transferrin receptor antibody of the present disclosure comprises a CDR-H1, a CDR-H2, and a CDR-H3, at least one of which contains no more than 3 amino acid variations (e.g., no more than 3, 2, or 1 amino acid variation) as compared with the counterpart heavy chain CDR as shown in Table 9. Alternatively or in addition (e.g., in addition), the transferrin receptor antibody of the present disclosure may comprise CDR-L1, a CDR-L2, and a CDR-L3, at least one of which contains no more than 3 amino acid variations (e.g., no more than 3, 2, or 1 amino acid variation) as compared with the counterpart light chain CDR as shown in Table 9.

In some embodiments, the transferrin receptor antibody of the present disclosure comprises a CDR-L3, which contains no more than 3 amino acid variations (e.g., no more than 3, 2, or 1 amino acid variation) as compared with the CDR-L3 as shown in Table 9. In some embodiments, the transferrin receptor antibody of the present disclosure comprises a CDR-L3 containing one amino acid variation as compared with the CDR-L3 as shown in Table 9. In some embodiments, the transferrin receptor antibody of the present disclosure comprises a CDR-L3 of QHFAGTPLT (SEQ ID NO: 126) according to the Kabat and Chothia definition system) or QHFAGTPL (SEQ ID NO: 127) according to the Contact definition system). In some embodiments, the transferrin receptor antibody of the present disclosure comprises a CDR-H1, a CDR-H2, a CDR-H3, a CDR-L1 and a CDR-L2 that are the same as the CDR-H1, CDR-H2, and CDR-H3 shown in Table 9, and comprises a CDR-L3 of QHFAGTPLT (SEQ ID NO: 126) according to the Kabat and Chothia definition system) or QHFAGTPL (SEQ ID NO: 127) according to the Contact definition system).

In some embodiments, the transferrin receptor antibody of the present disclosure comprises heavy chain CDRs that collectively are at least 80% (e.g., 80%, 85%, 90%, 95%, or 98%) identical to the heavy chain CDRs as shown in Table 9. Alternatively or in addition (e.g., in addition), the transferrin receptor antibody of the present disclosure comprises light chain CDRs that collectively are at least 80% (e.g., 80%, 85%, 90%, 95%, or 98%) identical to the light chain CDRs as shown in Table 9.

In some embodiments, the transferrin receptor antibody of the present disclosure comprises a VH comprising the amino acid sequence of SEQ ID NO: 124. Alternatively or in addition (e.g., in addition), the transferrin receptor antibody of the present disclosure comprises a VL comprising the amino acid sequence of SEQ ID NO: 125.

In some embodiments, the transferrin receptor antibody of the present disclosure comprises a VH containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) as compared with the VH as set forth in SEQ ID NO: 124. Alternatively or in addition (e.g., in addition), the transferrin receptor antibody of the present disclosure comprises a VL containing no more than 15 amino acid variations (e.g., no more than 20, 19, 18, 17, 16, 15, 14, 13, 12, 11, 9, 8, 7, 6, 5, 4, 3, 2, or 1 amino acid variation) as compared with the VL as set forth in SEQ ID NO: 125.

In some embodiments, the transferrin receptor antibody of the present disclosure comprises a VH comprising an amino acid sequence that is at least 80% (e.g., 80%, 85%, 90%, 95%, or 98%) identical to the VH as set forth in SEQ ID NO: 124. Alternatively or in addition (e.g., in addition), the transferrin receptor antibody of the present disclosure comprises a VL comprising an amino acid sequence that is at least 80% (e.g., 80%, 85%, 90%, 95%, or 98%) identical to the VL as set forth in SEQ ID NO: 125.

In some embodiments, the transferrin receptor antibody of the present disclosure is a humanized antibody (e.g., a humanized variant of an antibody). In some embodiments, the transferrin receptor antibody of the present disclosure comprises a CDR-H1, a CDR-H2, a CDR-H3, a CDR-L1, a CDR-L2, and a CDR-L3 that are the same as the CDR-H1, CDR-H2, and CDR-H3 shown in Table 9, and comprises a humanized heavy chain variable region and/or (e.g., and) a humanized light chain variable region.

Humanized antibodies are human immunoglobulins (recipient antibody) in which residues from a complementary determining region (CDR) of the recipient are replaced by residues from a CDR of a non-human species (donor antibody) such as mouse, rat, or rabbit having the desired specificity, affinity, and capacity. In some embodiments, Fv framework region (FR) residues of the human immunoglobulin are replaced by corresponding non-human residues. Furthermore, the humanized antibody may comprise residues that are found neither in the recipient antibody nor in the imported CDR or framework sequences, but are included to further refine and optimize antibody performance. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region or domain (Fc), typically that of a human immunoglobulin. Antibodies may have Fc regions modified as described in WO 99/58572. Other forms of humanized antibodies have one or more CDRs (one, two, three, four, five, six) which are altered with respect to the original antibody, which are also termed one or more CDRs derived from one or more CDRs from the original antibody. Humanized antibodies may also involve affinity maturation.

In some embodiments, humanization is achieved by grafting the CDRs (e.g., as shown in Table 9) into the IGKV1-NL1*01 and IGHV1-3*01 human variable domains. In some embodiments, the transferrin receptor antibody of the present disclosure is a humanized variant comprising one or more amino acid substitutions at positions 9, 13, 17, 18, 40, 45, and 70 as compared with the VL as set forth in SEQ ID NO: 125, and/or (e.g., and) one or more amino acid substitutions at positions 1, 5, 7, 11, 12, 20, 38, 40, 44, 66, 75, 81, 83, 87, and 108 as compared with the VH as set forth in SEQ ID NO: 124. In some embodiments, the transferrin receptor antibody of the present disclosure is a humanized variant comprising amino acid substitutions at all of positions 9, 13, 17, 18, 40, 45, and 70 as compared with the VL as set forth in SEQ ID NO: 125, and/or (e.g., and) amino acid substitutions at all of positions 1, 5, 7, 11, 12, 20, 38, 40, 44, 66, 75, 81, 83, 87, and 108 as compared with the VH as set forth in SEQ ID NO: 124.

In some embodiments, the transferrin receptor antibody of the present disclosure is a humanized antibody and contains the residues at positions 43 and 48 of the VL as set forth in SEQ ID NO: 125. Alternatively or in addition (e.g., in addition), the transferrin receptor antibody of the present disclosure is a humanized antibody and contains the residues at positions 48, 67, 69, 71, and 73 of the VH as set forth in SEQ ID NO: 124.

The VH and VL amino acid sequences of an example humanized antibody that may be used in accordance with the present disclosure are provided:

Humanized VH
(SEQ ID NO: 128)
EVQLVQSGAEVKKPGASVKVSCKASGYTFTSYWMHWVRQAPGQRLEWIGE

INPTNGRTNYIEKFKSRATLTVDKSASTAYMELSSLRSEDTAVYYCARGT

RAYHYWGQGTMVTVSS

Humanized VL
(SEQ ID NO: 129)
DIQMTQSPSSLSASVGDRVTITCRASDNLYSNLAWYQQKPGKSPKLLVYD

ATNLADGVPSRFSGSGSGTDYTLTISSLQPEDFATYYCQHFWGTPLTFGQ

GTKVEIK

In some embodiments, the transferrin receptor antibody of the present disclosure comprises a VH comprising the amino acid sequence of SEQ ID NO: 128. Alternatively or in addition (e.g., in addition), the transferrin receptor antibody of the present disclosure comprises a VL comprising the amino acid sequence of SEQ ID NO: 129.

In some embodiments, the transferrin receptor antibody of the present disclosure comprises a VH containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) as compared with the VH as set forth in SEQ ID NO: 128. Alternatively or in addition (e.g., in addition), the transferrin receptor antibody of the present disclosure comprises a VL containing no more than 15 amino acid variations (e.g., no more than 20, 19, 18, 17, 16, 15, 14, 13, 12, 11, 9, 8, 7, 6, 5, 4, 3, 2, or 1 amino acid variation) as compared with the VL as set forth in SEQ ID NO: 129.

In some embodiments, the transferrin receptor antibody of the present disclosure comprises a VH comprising an amino acid sequence that is at least 80% (e.g., 80%, 85%, 90%, 95%, or 98%) identical to the VH as set forth in SEQ ID NO: 128. Alternatively or in addition (e.g., in addition), the transferrin receptor antibody of the present disclosure comprises a VL comprising an amino acid sequence that is at least 80% (e.g., 80%, 85%, 90%, 95%, or 98%) identical to the VL as set forth in SEQ ID NO: 129.

In some embodiments, the transferrin receptor antibody of the present disclosure is a humanized variant comprising amino acid substitutions at one or more of positions 43 and 48 as compared with the VL as set forth in SEQ ID NO: 125, and/or (e.g., and) amino acid substitutions at one or more of positions 48, 67, 69, 71, and 73 as compared with the VH as set forth in SEQ ID NO: 124. In some embodiments, the transferrin receptor antibody of the present disclosure is a humanized variant comprising a S43A and/or (e.g., and) a V48L mutation as compared with the VL as set forth in SEQ ID NO: 125, and/or (e.g., and) one or more of A67V, L69I, V71R, and K73T mutations as compared with the VH as set forth in SEQ ID NO: 124.

In some embodiments, the transferrin receptor antibody of the present disclosure is a humanized variant comprising amino acid substitutions at one or more of positions 9, 13, 17, 18, 40, 43, 48, 45, and 70 as compared with the VL as set forth in SEQ ID NO: 125, and/or (e.g., and) amino acid substitutions at one or more of positions 1, 5, 7, 11, 12, 20, 38, 40, 44, 48, 66, 67, 69, 71, 73, 75, 81, 83, 87, and 108 as compared with the VH as set forth in SEQ ID NO: 124.

In some embodiments, the transferrin receptor antibody of the present disclosure is a chimeric antibody, which can include a heavy constant region and a light constant region from a human antibody. Chimeric antibodies refer to antibodies having a variable region or part of variable region from a first species and a constant region from a second species. Typically, in these chimeric antibodies, the variable region of both light and heavy chains mimics the variable regions of antibodies derived from one species of mammals (e.g., a non-human mammal such as mouse, rabbit, and rat), while the constant portions are homologous to the sequences in antibodies derived from another mammal such as human. In some embodiments, amino acid modifications can be made in the variable region and/or (e.g., and) the constant region.

In some embodiments, the transferrin receptor antibody described herein is a chimeric antibody, which can include a heavy constant region and a light constant region from a human antibody. Chimeric antibodies refer to antibodies having a variable region or part of variable region from a first species and a constant region from a second species. Typically, in these chimeric antibodies, the variable region of both light and heavy chains mimics the variable regions of antibodies derived from one species of mammals (e.g., a non-human mammal such as mouse, rabbit, and rat), while the constant portions are homologous to the sequences in antibodies derived from another mammal such as human. In some embodiments, amino acid modifications can be made in the variable region and/or (e.g., and) the constant region.

In some embodiments, the heavy chain of any of the transferrin receptor antibodies as described herein may comprises a heavy chain constant region (CH) or a portion thereof (e.g., CH1, CH2, CH3, or a combination thereof). The heavy chain constant region can of any suitable origin, e.g., human, mouse, rat, or rabbit. In one specific example, the heavy chain constant region is from a human IgG (a gamma heavy chain), e.g., IgG1, IgG2, or IgG4. An example of a human IgG1 constant region is given below:

```
                                    (SEQ ID NO: 130)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSRDELTKNQVSLTC

LVKGFYPSDIAVEWESNGQPENNYKTTPPVLDSDGSFFLYSKLTVDKSRW

QQGNVFSCSVMHEALHNHYTQKSLSLSPGK
```

In some embodiments, the light chain of any of the transferrin receptor antibodies described herein may further comprise a light chain constant region (CL), which can be any CL known in the art. In some examples, the CL is a kappa light chain. In other examples, the CL is a lambda light chain. In some embodiments, the CL is a kappa light chain, the sequence of which is provided below:

```
                                    (SEQ ID NO: 83)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC
```

Other antibody heavy and light chain constant regions are well known in the art, e.g., those provided in the IMGT database (www.imgt.org) or at www.vbase2.org/vbstat.php., both of which are incorporated by reference herein.

Examples of heavy chain and light chain amino acid sequences of the transferrin receptor antibodies described are provided below:

```
Heavy Chain (VH + human IgG1 constant region)
                                    (SEQ ID NO: 132)
QVQLQQPGAELVKPGASVKLSCKASGYTFTSYWMHWVKQRPGQGLEWIGE

INPTNGRTNYIEKFKSKATLTVDKSSSTAYMQLSSLTSEDSAVYYCARGT

RAYHYWGQGTSVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKKVEPKSCDKTHTCPPCPAPELLGGPSVFLFPPKPKDTL

MISRTPEVTCVVVDVSHEDPEVKFNWYVDGVEVHNAKTKPREEQYNSTYR

VVSVLTVLHQDWLNGKEYKCKVSNKALPAPIEKTISKAKGQPREPQVYTL

PPSRDELTKNQVSLTCLVKGFYPSDIAVEWESNGQPENNYKTTPPVLDSD

GSFFLYSKLTVDKSRWQQGNVFSCSVMHEALHNHYTQKSLSLSPGK

Light Chain (VL + kappa light chain)
                                    (SEQ ID NO: 133)
DIQMTQSPASLSVSVGETVTITCRASDNLYSNLAWYQQKQGKSPQLLVYD

ATNLADGVPSRFSGSGSGTQYSLKINSLQSEDFGTYYCQHFWGTPLTFGA

GTKLELKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC

Heavy Chain (humanized VH + human IgG1 constant
region)
                                    (SEQ ID NO: 134)
EVQLVQSGAEVKKPGASVKVSCKASGYTFTSYWMHWVRQAPGQRLEWIGE

INPTNGRTNYIEKFKSRATLTVDKSASTAYMELSSLRSEDTAVYYCARGT

RAYHYWGQGTMVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKKVEPKSCDKTHTCPPCPAPELLGGPSVFLFPPKPKDTL

MISRTPEVTCVVVDVSHEDPEVKFNWYVDGVEVHNAKTKPREEQYNSTYR

VVSVLTVLHQDWLNGKEYKCKVSNKALPAPIEKTISKAKGQPREPQVYTL

PPSRDELTKNQVSLTCLVKGFYPSDIAVEWESNGQPENNYKTTPPVLDSD

GSFFLYSKLTVDKSRWQQGNVFSCSVMHEALHNHYTQKSLSLSPGK

Light Chain (humanized VL + kappa light chain)
                                    (SEQ ID NO: 135)
DIQMTQSPSSLSASVGDRVTITCRASDNLYSNLAWYQQKPGKSPKLLVYD

ATNLADGVPSRFSGSGSGTDYTLTISSLQPEDFATYYCQHFWGTPLTFGQ

GTKVEIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC
```

In some embodiments, the transferrin receptor antibody described herein comprises a heavy chain comprising an amino acid sequence that is at least 80% (e.g., 80%, 85%, 90%, 95%, or 98%) identical to SEQ ID NO: 132. Alternatively or in addition (e.g., in addition), the transferrin receptor antibody described herein comprises a light chain comprising an amino acid sequence that is at least 80% (e.g., 80%, 85%, 90%, 95%, or 98%) identical to SEQ ID NO: 133. In some embodiments, the transferrin receptor antibody described herein comprises a heavy chain comprising the amino acid sequence of SEQ ID NO: 132. Alternatively or in addition (e.g., in addition), the transferrin receptor antibody described herein comprises a light chain comprising the amino acid sequence of SEQ ID NO: 133.

In some embodiments, the transferrin receptor antibody of the present disclosure comprises a heavy chain containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) as compared with the heavy chain as set forth in SEQ ID NO: 132. Alternatively or in addition (e.g., in addition), the transferrin receptor antibody of the present disclosure comprises a light chain containing no more than 15 amino acid variations (e.g., no more than 20, 19, 18, 17, 16, 15, 14, 13, 12, 11, 9, 8, 7, 6, 5, 4, 3, 2, or 1 amino acid variation) as compared with the light chain as set forth in SEQ ID NO: 133.

In some embodiments, the transferrin receptor antibody described herein comprises a heavy chain comprising an amino acid sequence that is at least 80% (e.g., 80%, 85%, 90%, 95%, or 98%) identical to SEQ ID NO: 134. Alternatively or in addition (e.g., in addition), the transferrin receptor antibody described herein comprises a light chain comprising an amino acid sequence that is at least 80% (e.g., 80%, 85%, 90%, 95%, or 98%) identical to SEQ ID NO: 135. In some embodiments, the transferrin receptor antibody described herein comprises a heavy chain comprising the amino acid sequence of SEQ ID NO: 134. Alternatively or in addition (e.g., in addition), the transferrin receptor antibody described herein comprises a light chain comprising the amino acid sequence of SEQ ID NO: 135.

In some embodiments, the transferrin receptor antibody of the present disclosure comprises a heavy chain containing no more than 25 amino acid variations (e.g., no more than 25, 24, 23, 22, 21, 20, 19, 18, 17, 16, 15, 14, 13, 12, 11, 10, 9, 8, 7, 6, 5, 4, 3, 2, or 1 amino acid variation) as compared with the heavy chain of humanized antibody as set forth in SEQ ID NO: 134. Alternatively or in addition (e.g., in addition), the transferrin receptor antibody of the present disclosure comprises a light chain containing no more than 15 amino acid variations (e.g., no more than 20, 19, 18, 17, 16, 15, 14, 13, 12, 11, 9, 8, 7, 6, 5, 4, 3, 2, or 1 amino acid variation) as compared with the light chain of humanized antibody as set forth in SEQ ID NO: 135.

In some embodiments, the transferrin receptor antibody is an antigen binding fragment (Fab) of an intact antibody (full-length antibody). Antigen binding fragment of an intact antibody (full-length antibody) can be prepared via routine methods. For example, F(ab')2 fragments can be produced by pepsin digestion of an antibody molecule, and Fab' fragments that can be generated by reducing the disulfide bridges of F(ab')2 fragments. Examples of Fab amino acid sequences of the transferrin receptor antibodies described herein are provided below:

Heavy Chain Fab (VH + a portion of human IgG1 constant region)
(SEQ ID NO: 136)
QVQLQQPGAELVKPGASVKLSCKASGYTFTSYWMHWVKQRPGQGLEWIGE

INPTNGRTNYIEKFKSKATLTVDKSSSTAYMQLSSLTSEDSAVYYCARGT

RAYHYWGQGTSVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKKVEPKSCDKTHTCP

-continued
Heavy Chain Fab (humanized VH + a portion of human IgG1 constant region)
(SEQ ID NO: 137)
EVQLVQSGAEVKKPGASVKVSCKASGYTFTSYWMHWVRQAPGQRLEWIGE

INPTNGRTNYIEKFKSRATLTVDKSASTAYMELSSLRSEDTAVYYCARGT

RAYHYWGQGTMVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKKVEPKSCDKTHTCP

In some embodiments, the transferrin receptor antibody described herein comprises a heavy chain comprising the amino acid sequence of SEQ ID NO: 136. Alternatively or in addition (e.g., in addition), the transferrin receptor antibody described herein comprises a light chain comprising the amino acid sequence of SEQ ID NO: 133.

In some embodiments, the transferrin receptor antibody described herein comprises a heavy chain comprising the amino acid sequence of SEQ ID NO: 137. Alternatively or in addition (e.g., in addition), the transferrin receptor antibody described herein comprises a light chain comprising the amino acid sequence of SEQ ID NO: 135.

The transferrin receptor antibodies described herein can be in any antibody form, including, but not limited to, intact (i.e., full-length) antibodies, antigen-binding fragments thereof (such as Fab, Fab', F(ab')2, Fv), single chain antibodies, bi-specific antibodies, or nanobodies. In some embodiments, the transferrin receptor antibody described herein is a scFv. In some embodiments, the transferrin receptor antibody described herein is a scFv-Fab (e.g., scFv fused to a portion of a constant region). In some embodiments, the transferrin receptor antibody described herein is a scFv fused to a constant region (e.g., human IgG1 constant region as set forth in SEQ ID NO: 130).

In some embodiments, any one of the anti-TfR antibodies described herein is produced by recombinant DNA technology in Chinese hamster ovary (CHO) cell suspension culture, optionally in CHO-K1 cell (e.g., CHO-K1 cells derived from European Collection of Animal Cell Culture, Cat. No. 85051005) suspension culture.

In some embodiments, an antibody provided herein may have one or more post-translational modifications. In some embodiments, N-terminal cyclization, also called pyroglutamate formation (pyro-Glu), may occur in the antibody at N-terminal Glutamate (Glu) and/or Glutamine (Gln) residues during production. As such, it should be appreciated that an antibody specified as having a sequence comprising an N-terminal glutamate or glutamine residue encompasses antibodies that have undergone pyroglutamate formation resulting from a post-translational modification. In some embodiments, pyroglutamate formation occurs in a heavy chain sequence. In some embodiments, pyroglutamate formation occurs in a light chain sequence.

b. Other Muscle-Targeting Antibodies

In some embodiments, the muscle-targeting antibody is an antibody that specifically binds hemojuvelin, caveolin-3, Duchenne muscular dystrophy peptide, myosin lib, or CD63. In some embodiments, the muscle-targeting antibody is an antibody that specifically binds a myogenic precursor protein. Exemplary myogenic precursor proteins include, without limitation, ABCG2, M-Cadherin/Cadherin-15, Caveolin-1, CD34, FoxK1, Integrin alpha 7, Integrin alpha 7 beta 1, MYF-5, MyoD, Myogenin, NCAM-1/CD56, Pax3, Pax7, and Pax9. In some embodiments, the muscle-targeting antibody is an antibody that specifically binds a skeletal muscle protein. Exemplary skeletal muscle proteins include, without limitation, alpha-Sarcoglycan, beta-Sarcoglycan, Calpain Inhibitors, Creatine Kinase MM/CKMM, cIF5A, Enolase 2/Neuron-specific Enolase, epsilon-Sarcoglycan, FABP3/H-FABP, GDF-8/Myostatin, GDF-11/GDF-8, Integrin alpha 7, Integrin alpha 7 beta 1, Integrin beta 1/CD29, MCAM/CD146, MyoD, Myogenin, Myosin Light Chain Kinase Inhibitors, NCAM-1/CD56, and Troponin I. In some embodiments, the muscle-targeting antibody is an antibody that specifically binds a smooth muscle protein. Exemplary smooth muscle proteins include, without limitation, alpha-Smooth Muscle Actin, VE-Cadherin, Caldesmon/CALD1, Calponin 1, Desmin, Histamine H2 R, Motilin R/GPR38, Transgelin/TAGLN, and Vimentin. However, it should be appreciated that antibodies to additional targets are within the scope of this disclosure and the exemplary lists of targets provided herein are not meant to be limiting.

c. Antibody Features/Alterations

In some embodiments, conservative mutations can be introduced into antibody sequences (e.g., CDRs or framework sequences) at positions where the residues are not likely to be involved in interacting with a target antigen (e.g., transferrin receptor), for example, as determined based on a crystal structure. In some embodiments, one, two or more mutations (e.g., amino acid substitutions) are introduced into the Fc region of a muscle-targeting antibody described herein (e.g., in a CH2 domain (residues 231-340 of human IgG1) and/or (e.g., and) CH3 domain (residues 341-447 of human IgG1) and/or (e.g., and) the hinge region, with numbering according to the Kabat numbering system (e.g., the EU index in Kabat)) to alter one or more functional properties of the antibody, such as serum half-life, complement fixation, Fc receptor binding and/or (e.g., and) antigen-dependent cellular cytotoxicity.

In some embodiments, one, two or more mutations (e.g., amino acid substitutions) are introduced into the hinge region of the Fc region (CH1 domain) such that the number of cysteine residues in the hinge region are altered (e.g., increased or decreased) as described in, e.g., U.S. Pat. No. 5,677,425. The number of cysteine residues in the hinge region of the CH1 domain can be altered to, e.g., facilitate assembly of the light and heavy chains, or to alter (e.g., increase or decrease) the stability of the antibody or to facilitate linker conjugation.

In some embodiments, one, two or more mutations (e.g., amino acid substitutions) are introduced into the Fc region of a muscle-targeting antibody described herein (e.g., in a CH2 domain (residues 231-340 of human IgG1) and/or (e.g., and) CH3 domain (residues 341-447 of human IgG1) and/or (e.g., and) the hinge region, with numbering according to the Kabat numbering system (e.g., the EU index in Kabat)) to increase or decrease the affinity of the antibody for an Fc receptor (e.g., an activated Fc receptor) on the surface of an effector cell. Mutations in the Fc region of an antibody that decrease or increase the affinity of an antibody for an Fc receptor and techniques for introducing such mutations into the Fc receptor or fragment thereof are known to one of skill in the art. Examples of mutations in the Fc receptor of an antibody that can be made to alter the affinity of the antibody for an Fc receptor are described in, e.g., Smith P et al., (2012) PNAS 109:6181-6186, U.S. Pat. No. 6,737,056, and International Publication Nos. WO 02/060919; WO 98/23289; and WO 97/34631, which are incorporated herein by reference.

In some embodiments, one, two or more amino acid mutations (i.e., substitutions, insertions or deletions) are introduced into an IgG constant domain, or FcRn-binding fragment thereof (preferably an Fc or hinge-Fc domain fragment) to alter (e.g., decrease or increase) half-life of the antibody in vivo. Sec, e.g., International Publication Nos. WO 02/060919; WO 98/23289; and WO 97/34631; and U.S. Pat. Nos. 5,869,046, 6,121,022, 6,277,375 and 6,165,745 for examples of mutations that will alter (e.g., decrease or increase) the half-life of an antibody in vivo.

In some embodiments, one, two or more amino acid mutations (i.e., substitutions, insertions or deletions) are introduced into an IgG constant domain, or FcRn-binding fragment thereof (preferably an Fc or hinge-Fc domain fragment) to decrease the half-life of the anti-transferrin receptor antibody in vivo. In some embodiments, one, two or more amino acid mutations (i.e., substitutions, insertions or deletions) are introduced into an IgG constant domain, or FcRn-binding fragment thereof (preferably an Fc or hinge-Fc domain fragment) to increase the half-life of the antibody in vivo. In some embodiments, the antibodies can have one or more amino acid mutations (e.g., substitutions) in the second constant (CH2) domain (residues 231-340 of human IgG1) and/or (e.g., and) the third constant (CH3) domain (residues 341-447 of human IgG1), with numbering according to the EU index in Kabat (Kabat E A ct al., (1991) supra). In some embodiments, the constant region of the IgG1 of an antibody described herein comprises a methionine (M) to tyrosine (Y) substitution in position 252, a serine(S) to threonine (T) substitution in position 254, and a threonine (T) to glutamic acid (E) substitution in position 256, numbered according to the EU index as in Kabat. See U.S. Pat. No. 7,658,921, which is incorporated herein by reference. This type of mutant IgG, referred to as "YTE mutant" has been shown to display fourfold increased half-life as compared to wild-type versions of the same antibody (see Dall'Acqua W F et al., (2006) J Biol Chem 281:23514-24). In some embodiments, an antibody comprises an IgG constant domain comprising one, two, three or more amino acid substitutions of amino acid residues at positions 251-257, 285-290, 308-314, 385-389, and 428-436, numbered according to the EU index as in Kabat.

In some embodiments, one, two or more amino acid substitutions are introduced into an IgG constant domain Fc region to alter the effector function(s) of the anti-transferrin receptor antibody. The effector ligand to which affinity is altered can be, for example, an Fc receptor or the C1 component of complement. This approach is described in further detail in U.S. Pat. Nos. 5,624,821 and 5,648,260. In some embodiments, the deletion or inactivation (through point mutations or other means) of a constant region domain can reduce Fc receptor binding of the circulating antibody thereby increasing tumor localization. Sec, e.g., U.S. Pat. Nos. 5,585,097 and 8,591,886 for a description of mutations that delete or inactivate the constant domain and thereby increase tumor localization. In some embodiments, one or more amino acid substitutions may be introduced into the Fc region of an antibody described herein to remove potential glycosylation sites on Fc region, which may reduce Fc receptor binding (see, e.g., Shields R L et al., (2001) J Biol Chem 276:6591-604).

In some embodiments, one or more amino in the constant region of a muscle-targeting antibody described herein can be replaced with a different amino acid residue such that the antibody has altered C1q binding and/or (e.g., and) reduced or abolished complement dependent cytotoxicity (CDC). This approach is described in further detail in U.S. Pat. No. 6,194,551 (Idusogie et al). In some embodiments, one or more amino acid residues in the N-terminal region of the CH2 domain of an antibody described herein are altered to thereby alter the ability of the antibody to fix complement. This approach is described further in International Publication No. WO 94/29351. In some embodiments, the Fc region of an antibody described herein is modified to increase the ability of the antibody to mediate antibody dependent cellular cytotoxicity (ADCC) and/or (e.g., and) to increase the affinity of the antibody for an Fcγ receptor. This approach is described further in International Publication No. WO 00/42072.

In some embodiments, the heavy and/or (e.g., and) light chain variable domain(s) sequence(s) of the antibodies provided herein can be used to generate, for example, CDR-grafted, chimeric, humanized, or composite human antibodies or antigen-binding fragments, as described elsewhere herein. As understood by one of ordinary skill in the art, any variant, CDR-grafted, chimeric, humanized, or composite antibodies derived from any of the antibodies provided herein may be useful in the compositions and methods described herein and will maintain the ability to specifically bind transferrin receptor, such that the variant, CDR-grafted, chimeric, humanized, or composite antibody has at least 50%, at least 60%, at least 70%, at least 80%, at least 90%, at least 95% or more binding to transferrin receptor relative to the original antibody from which it is derived.

In some embodiments, the antibodies provided herein comprise mutations that confer desirable properties to the antibodies. For example, to avoid potential complications due to Fab-arm exchange, which is known to occur with native IgG4 mAbs, the antibodies provided herein may comprise a stabilizing 'Adair' mutation (Angal S., et al., "A single amino acid substitution abolishes the heterogeneity of chimeric mouse/human (IgG4) antibody," Mol Immunol 30, 105-108; 1993), where serine 228 (EU numbering; residue 241 Kabat numbering) is converted to proline resulting in an IgG1-like hinge sequence. Accordingly, any of the antibodies may include a stabilizing 'Adair' mutation.

As provided herein, antibodies of this disclosure may optionally comprise constant regions or parts thereof. For example, a VL domain may be attached at its C-terminal end to a light chain constant domain like Cκ or Cλ. Similarly, a VH domain or portion thereof may be attached to all or part of a heavy chain like IgA, IgD, IgE, IgG, and IgM, and any isotype subclass. Antibodies may include suitable constant regions (see, for example, Kabat ct al., Sequences of Proteins of Immunological Interest, No. 91-3242, National Institutes of Health Publications, Bethesda, Md. (1991)). Therefore, antibodies within the scope of this may disclosure include VH and VL domains, or an antigen binding portion thereof, combined with any suitable constant regions.

ii. Muscle-Targeting Peptides

Some aspects of the disclosure provide muscle-targeting peptides as muscle-targeting agents. Short peptide sequences (e.g., peptide sequences of 5-20 amino acids in length) that bind to specific cell types have been described. For example, cell-targeting peptides have been described in Vines e., et al., A. "Cell-penetrating and cell-targeting peptides in drug delivery" Biochim Biophys Acta 2008, 1786: 126-38; Jarver P., et al., "In vivo biodistribution and efficacy of peptide mediated delivery" Trends Pharmacol Sci 2010; 31:528-35; Samoylova T. I., et al., "Elucidation of muscle-binding peptides by phage display screening" Muscle Nerve 1999; 22:460-6; U.S. Pat. No. 6,329,501, issued on Dec. 11, 2001, entitled "METHODS AND COMPOSITIONS FOR TARGETING COMPOUNDS TO MUSCLE"; and Samoylov A. M., et al., "Recognition of cell-specific binding of phage display derived peptides using an acoustic wave sensor." Biomol Eng 2002; 18:269-72; the entire contents of each of which are incorporated herein by reference. By designing peptides to interact with specific cell surface antigens (e.g., receptors), selectivity for a desired tissue, e.g., muscle, can be achieved. Skeletal muscle-targeting has been investigated and a range of molecular payloads are able to be delivered. These approaches may have high selectivity for muscle tissue without many of the practical disadvantages of a large antibody or viral particle. Accordingly, in some embodiments, the muscle-targeting agent is a muscle-targeting peptide that is from 4 to 50 amino acids in length. In some embodiments, the muscle-targeting peptide is 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 amino acids in length. Muscle-targeting peptides can be generated using any of several methods, such as phage display.

In some embodiments, a muscle-targeting peptide may bind to an internalizing cell surface receptor that is overexpressed or relatively highly expressed in muscle cells, e.g. a transferrin receptor, compared with certain other cells. In some embodiments, a muscle-targeting peptide may target, e.g., bind to, a transferrin receptor. In some embodiments, a peptide that targets a transferrin receptor may comprise a segment of a naturally occurring ligand, e.g., transferrin. In some embodiments, a peptide that targets a transferrin receptor is as described in U.S. Pat. No. 6,743,893, filed Nov. 30, 2000, "RECEPTOR-MEDIATED UPTAKE OF PEPTIDES THAT BIND THE HUMAN TRANSFERRIN RECEPTOR". In some embodiments, a peptide that targets a transferrin receptor is as described in Kawamoto, M. et al, "A novel transferrin receptor-targeted hybrid peptide disintegrates cancer cell membrane to induce rapid killing of cancer cells." BMC Cancer. 2011 Aug. 18; 11:359. In some embodiments, a peptide that targets a transferrin receptor is as described in U.S. Pat. No. 8,399,653, filed May 20, 2011, "TRANSFERRIN/TRANSFERRIN RECEPTOR-MEDIATED SIRNA DELIVERY".

As discussed above, examples of muscle targeting peptides have been reported. For example, muscle-specific peptides were identified using phage display library presenting surface heptapeptides. As one example a peptide having the amino acid sequence ASSLNIA (SEQ ID NO: 138) bound to C2C12 murine myotubes in vitro, and bound to mouse muscle tissue in vivo. Accordingly, in some embodiments, the muscle-targeting agent comprises the amino acid sequence ASSLNIA (SEQ ID NO: 138). This peptide displayed improved specificity for binding to heart and skeletal muscle tissue after intravenous injection in mice with reduced binding to liver, kidney, and brain. Additional muscle-specific peptides have been identified using phage display. For example, a 12 amino acid peptide was identified by phage display library for muscle targeting in the context of treatment for DMD. Sec, Yoshida D., et al., "Targeting of salicylate to skin and muscle following topical injections in rats." Int J Pharm 2002; 231:177-84; the entire contents of which are hereby incorporated by reference. Here, a 12 amino acid peptide having the sequence SKTFNTHPQSTP (SEQ ID NO: 139) was identified and this muscle-targeting peptide showed improved binding to C2C12 cells relative to the ASSLNIA (SEQ ID NO: 138) peptide.

An additional method for identifying peptides selective for muscle (e.g., skeletal muscle) over other cell types includes in vitro selection, which has been described in Ghosh D., et al., "Selection of muscle-binding peptides from context-specific peptide-presenting phage libraries for adenoviral vector targeting" J Virol 2005; 79:13667-72; the entire contents of which are incorporated herein by reference. By pre-incubating a random 12-mer peptide phage display library with a mixture of non-muscle cell types, non-specific cell binders were selected out. Following rounds of selection the 12 amino acid peptide TARGEH-KEEELI (SEQ ID NO: 140) appeared most frequently. Accordingly, in some embodiments, the muscle-targeting agent comprises the amino acid sequence TARGEHKEEELI (SEQ ID NO: 140).

A muscle-targeting agent may an amino acid-containing molecule or peptide. A muscle-targeting peptide may correspond to a sequence of a protein that preferentially binds to a protein receptor found in muscle cells. In some embodiments, a muscle-targeting peptide contains a high propensity of hydrophobic amino acids, e.g. valine, such that the peptide preferentially targets muscle cells. In some embodiments, a muscle-targeting peptide has not been previously characterized or disclosed. These peptides may be conceived of, produced, synthesized, and/or (e.g., and) derivatized using any of several methodologies, e.g. phage displayed peptide libraries, one-bead one-compound peptide libraries, or positional scanning synthetic peptide combinatorial libraries. Exemplary methodologies have been characterized in the art and are incorporated by reference (Gray, B. P. and Brown, K. C. "Combinatorial Peptide Libraries: Mining for Cell-Binding Peptides" Chem Rev. 2014, 114:2, 1020-1081.; Samoylova, T. I. and Smith, B. F. "Elucidation of muscle-binding peptides by phage display screening." Muscle Nerve, 1999, 22:4. 460-6.). In some embodiments, a muscle-targeting peptide has been previously disclosed (see, e.g. Writer M. J. et al. "Targeted gene delivery to human airway epithelial cells with synthetic vectors incorporating novel targeting peptides selected by phage display." J. Drug Targeting. 2004; 12:185; Cai, D. "BDNF-mediated enhancement of inflammation and injury in the aging heart." Physiol Genomics. 2006, 24:3, 191-7.; Zhang, L. "Molecular profiling of heart endothelial cells." Circulation, 2005, 112:11, 1601-11.; McGuire, M. J. et al. "In vitro selection of a peptide with high selectivity for cardiomyocytes in vivo." J Mol Biol. 2004, 342:1, 171-82.). Exemplary muscle-targeting peptides comprise an amino acid sequence of the following group: CQAQGQLVC (SEQ ID NO: 141), CSERSMNFC (SEQ ID NO: 142), CPKTRRVPC (SEQ ID NO: 143), WLSEAGPVVTVRALRGTGSW (SEQ ID NO: 144), ASSLNIA (SEQ ID NO: 138), CMQHSMRVC (SEQ ID NO: 145), and DDTRHWG (SEQ ID NO: 146). In some embodiments, a muscle-targeting peptide may comprise about 2-25 amino acids, about 2-20 amino acids, about 2-15 amino acids, about 2-10 amino acids, or about 2-5 amino acids. Muscle-targeting peptides may comprise naturally-occurring amino acids, e.g. cysteine, alanine, or non-naturally-occurring or modified amino acids. Non-naturally occurring amino acids include β-amino acids, homo-amino acids, proline derivatives, 3-substituted alanine derivatives, linear core amino acids, N-methyl amino acids, and others known in the art. In some embodiments, a muscle-targeting peptide may be linear; in other embodiments, a muscle-targeting peptide may be cyclic, e.g. bicyclic (see, e.g. Silvana, M. G. et al. Mol. Therapy, 2018, 26:1, 132-147.).

iii. Muscle-Targeting Receptor Ligands

A muscle-targeting agent may be a ligand, e.g. a ligand that binds to a receptor protein. A muscle-targeting ligand may be a protein, e.g. transferrin, which binds to an internalizing cell surface receptor expressed by a muscle cell. Accordingly, in some embodiments, the muscle-targeting agent is transferrin, or a derivative thereof that binds to a transferrin receptor. A muscle-targeting ligand may alternatively be a small molecule, e.g. a lipophilic small molecule that preferentially targets muscle cells relative to other cell types. Exemplary lipophilic small molecules that may target muscle cells include compounds comprising cholesterol, cholesteryl, stearic acid, palmitic acid, oleic acid, oleyl, linolene, linoleic acid, myristic acid, sterols, dihydrotestosterone, testosterone derivatives, glycerine, alkyl chains, trityl groups, and alkoxy acids.

iv. Muscle-Targeting Aptamers

A muscle-targeting agent may be an aptamer, e.g. an RNA aptamer, which preferentially targets muscle cells relative to other cell types. In some embodiments, a muscle-targeting aptamer has not been previously characterized or disclosed. These aptamers may be conceived of, produced, synthesized, and/or (e.g., and) derivatized using any of several methodologies, e.g. Systematic Evolution of Ligands by Exponential Enrichment. Exemplary methodologies have been characterized in the art and are incorporated by reference (Yan, A. C. and Levy, M. "Aptamers and aptamer targeted delivery" RNA biology, 2009, 6:3, 316-20.; Germer, K. et al. "RNA aptamers and their therapeutic and diagnostic applications." Int. J. Biochem. Mol. Biol. 2013; 4:27-40.). In some embodiments, a muscle-targeting aptamer has been previously disclosed (see, e.g. Phillippou, S. et al. "Selection and Identification of Skeletal-Muscle-Targeted RNA Aptamers." Mol Ther Nucleic Acids. 2018, 10:199-214.; Thiel, W. H. et al. "Smooth Muscle Cell-targeted RNA Aptamer Inhibits Neointimal Formation." Mol Ther. 2016, 24:4, 779-87.). Exemplary muscle-targeting aptamers include the A01B RNA aptamer and RNA Apt 14. In some embodiments, an aptamer is a nucleic acid-based aptamer, an oligonucleotide aptamer or a peptide aptamer. In some embodiments, an aptamer may be about 5-15 kDa, about 5-10 kDa, about 10-15 kDa, about 1-5 Da, about 1-3 kDa, or smaller.

v. Other Muscle-Targeting Agents

One strategy for targeting a muscle cell (e.g., a skeletal muscle cell) is to use a substrate of a muscle transporter protein, such as a transporter protein expressed on the sarcolemma. In some embodiments, the muscle-targeting agent is a substrate of an influx transporter that is specific to muscle tissue. In some embodiments, the influx transporter is specific to skeletal muscle tissue. Two main classes of transporters are expressed on the skeletal muscle sarcolemma, (1) the adenosine triphosphate (ATP) binding cassette (ABC) superfamily, which facilitate efflux from skeletal muscle tissue and (2) the solute carrier (SLC) superfamily, which can facilitate the influx of substrates into skeletal muscle. In some embodiments, the muscle-targeting agent is a substrate that binds to an ABC superfamily or an SLC superfamily of transporters. In some embodiments, the substrate that binds to the ABC or SLC superfamily of transporters is a naturally-occurring substrate. In some embodiments, the substrate that binds to the ABC or SLC superfamily of transporters is a non-naturally occurring substrate, for example, a synthetic derivative thereof that binds to the ABC or SLC superfamily of transporters.

In some embodiments, the muscle-targeting agent is a substrate of an SLC superfamily of transporters. SLC transporters are either equilibrative or use proton or sodium ion gradients created across the membrane to drive transport of substrates. Exemplary SLC transporters that have high skeletal muscle expression include, without limitation, the SATT transporter (ASCT1; SLC1A4), GLUT4 transporter (SLC2A4), GLUT7 transporter (GLUT7; SLC2A7), ATRC2 transporter (CAT-2; SLC7A2), LAT3 transporter (KIAA0245; SLC7A6), PHT1 transporter (PTR4; SLC15A4), OATP-J transporter (OATP5A1; SLC21A15), OCT3 transporter (EMT; SLC22A3), OCTN2 transporter (FLJ46769; SLC22A5), ENT transporters (ENT1; SLC29A1 and ENT2; SLC29A2), PAT2 transporter (SLC36A2), and SAT2 transporter (KIAA1382; SLC38A2).

These transporters can facilitate the influx of substrates into skeletal muscle, providing opportunities for muscle targeting.

In some embodiments, the muscle-targeting agent is a substrate of an equilibrative nucleoside transporter 2 (ENT2) transporter. Relative to other transporters, ENT2 has one of the highest mRNA expressions in skeletal muscle. While human ENT2 (hENT2) is expressed in most body organs such as brain, heart, placenta, thymus, pancreas, prostate, and kidney, it is especially abundant in skeletal muscle. Human ENT2 facilitates the uptake of its substrates depending on their concentration gradient. ENT2 plays a role in maintaining nucleoside homeostasis by transporting a wide range of purine and pyrimidine nucleobases. The hENT2 transporter has a low affinity for all nucleosides (adenosine, guanosine, uridine, thymidine, and cytidine) except for inosine. Accordingly, in some embodiments, the muscle-targeting agent is an ENT2 substrate. Exemplary ENT2 substrates include, without limitation, inosine, 2',3'-dideoxyinosine, and calofarabine. In some embodiments, any of the muscle-targeting agents provided herein are associated with a molecular payload (e.g., oligonucleotide payload). In some embodiments, the muscle-targeting agent is covalently linked to the molecular payload. In some embodiments, the muscle-targeting agent is non-covalently linked to the molecular payload.

In some embodiments, the muscle-targeting agent is a substrate of an organic cation/carnitine transporter (OCTN2), which is a sodium ion-dependent, high affinity carnitine transporter. In some embodiments, the muscle-targeting agent is carnitine, mildronate, acetylcarnitine, or any derivative thereof that binds to OCTN2. In some embodiments, the carnitine, mildronate, acetylcarnitine, or derivative thereof is covalently linked to the molecular payload (e.g., oligonucleotide payload).

A muscle-targeting agent may be a protein that is protein that exists in at least one soluble form that targets muscle cells. In some embodiments, a muscle-targeting protein may be hemojuvelin (also known as repulsive guidance molecule C or hemochromatosis type 2 protein), a protein involved in iron overload and homeostasis. In some embodiments, hemojuvelin may be full length or a fragment, or a mutant with at least 75%, at least 80%, at least 85%, at least 90%, at least 95%, at least 98% or at least 99% sequence identity to a functional hemojuvelin protein. In some embodiments, a hemojuvelin mutant may be a soluble fragment, may lack a N-terminal signaling, and/or (e.g., and) lack a C-terminal anchoring domain. In some embodiments, hemojuvelin may be annotated under GenBank RefSeq Accession Numbers NM_001316767.1, NM_145277.4, NM_202004.3, NM_213652.3, or NM_213653.3. It should be appreciated that a hemojuvelin may be of human, non-human primate, or rodent origin.

B. Molecular Payloads

Some aspects of the disclosure provide molecular payloads, e.g., for modulating a biological outcome, e.g., the transcription of a DNA sequence, the splicing and processing of a RNA sequence, the expression of a protein, or the activity of a protein. In some embodiments, a molecular payload is linked to, or otherwise associated with a muscle-targeting agent. In some embodiments, such molecular payloads are capable of targeting to a muscle cell, e.g., via specifically binding to a nucleic acid or protein in the muscle cell following delivery to the muscle cell by an associated muscle-targeting agent. It should be appreciated that various types of muscle-targeting agents may be used in accordance with the disclosure. For example, the molecular payload may comprise, or consist of, an oligonucleotide (e.g., antisense oligonucleotide), a peptide (e.g., a peptide that binds a nucleic acid or protein associated with disease in a muscle cell), a protein (e.g., a protein that binds a nucleic acid or protein associated with disease in a muscle cell), or a small molecule (e.g., a small molecule that modulates the function of a nucleic acid or protein associated with disease in a muscle cell). In some embodiments, the molecular payload is an oligonucleotide that comprises a strand having a region of complementarity to a mutated DMD allele. Exemplary molecular payloads are described in further detail herein, however, it should be appreciated that the exemplary molecular payloads provided herein are not meant to be limiting.

i. Oligonucleotides

Any suitable oligonucleotide may be used as a molecular payload, as described herein. In some embodiments, the oligonucleotide may be designed to induce exon skipping, e.g., EXONDYS 51 oligonucleotide (Sarepta Therapeutics, Inc.), which comprises SEQ ID NO: 343 (CUCCAACAUCAAGGAAGAUGGCAUUUCUAG); WVE-210201 (Wave Life Sciences), which comprises SEQ ID NO: 334 (UCAAGGAAGAUGGCAUUUCU); Casimersen (Sarepta Therapeutics, Inc.), which comprises SEQ ID NO: 302 (CAAUGCCAUCCUGGAGUUCCUG); or Golodirsen (Sarepta Therapeutics, Inc.), which comprises SEQ ID NO: 380 (GUUGCCUCCGGUUCUGAAGGUGUUC). In some embodiments, the oligonucleotide may be designed to induce exon skipping, e.g., viltolarsen (NS Pharma, Inc.), which comprises SEQ ID NO: 2257 (CCTCCGGTTCT-GAAGGTGTTC) or renadirsen (Daiichi Sankyo Company), which comprises SEQ ID NO: 2252 (CGCUGCC-CAAUGCCAUCC). In some embodiments, the oligonucleotide comprises a sequence or portion thereof (e.g., 10, 11, 12, 13, 14, 15, 16, 17, 18, 19, 20 or more consecutive nucleosides thereof) of a sequence provided in Table 10, and/or the oligonucleotide comprises a region of complementarity to a target sequence provided in Table 10. Any one or more of the thymine bases (T's) in any one of the oligonucleotides provided herein (e.g., the oligonucleotides listed in Table 10) may optionally be uracil bases (U's), and/or any one or more of the U's in the oligonucleotides provided herein may optionally be T's.

TABLE 10

Examples of oligonucleotide molecular payloads

| Name | SEQ ID NO: | Antisense Sequence† | SEQ ID NO: | Antisense Sequence† | SEQ ID NO: | Target Sequence† |
|---|---|---|---|---|---|---|
| EXONDYS 51 | 343 | CUCCAACAUC AAGGAAGAUG GCAUUUCUAG | 745 | CTCCAACATC AAGGAAGATG GCATTTCTAG | 1550 | CTAGAAATGC CATCTTCCTTG ATGTTGGAG |

TABLE 10-continued

Examples of oligonucleotide molecular payloads

| Name | SEQ ID NO: | Antisense Sequence† | SEQ ID NO: | Antisense Sequence† | SEQ ID NO: | Target Sequence† |
|---|---|---|---|---|---|---|
| WVE-210201 | 334 | UCAAGGAAGA UGGCAUUUCU | 2254 | TCAAGGAAGA TGGCATTTCT | 2259 | AGAAATGCCA TCTTCCTTGA |
| Casimersen | 302 | CAAUGCCAUC CUGGAGUUCC UG | 2255 | CAATGCCATC CTGGAGTTCC TG | 2260 | CAGGAACTCC AGGATGGCAT TG |
| Golodirsen | 380 | GUUGCCUCCG GUUCUGAAGG UGUUC | 2256 | GTTGCCTCCG GTTCTGAAGG TGTTC | 2261 | GAACACCTTC AGAACCGGAG GCAAC |
| Viltolarsen | 2251 | CCUCCGGUUC UGAAGGUGUU C | 2257 | CCTCCGGTTCT GAAGGTGTTC | 2262 | GAACACCTTC AGAACCGGAG G |
| Renadirsen | 2252 | CGCUGCCCAA UGCCAUCC | 2258 | CGCTGCCCAA TGCCATCC | 2263 | GGATGGCATT GGGCAGCG |

†Each thymine base (T) in any one of the oligonucleotides and/or target sequences provided in Table 10 may independently and optionally be replaced with a uracil base (U), and/or each U may independently and optionally be replaced with a T. Target sequences listed in Table 10 contain Ts, but binding of a DMD-targeting oligonucleotide to RNA and/or DNA is contemplated.

In some embodiments, the oligonucleotide may be designed to cause degradation of an mRNA (e.g., the oligonucleotide may be a gapmer, an siRNA, a ribozyme or an aptamer that causes degradation). In some embodiments, the oligonucleotide may be designed to block translation of an mRNA (e.g., the oligonucleotide may be a mixmer, an siRNA or an aptamer that blocks translation). In some embodiments, an oligonucleotide may be designed to cause degradation and block translation of an mRNA. In some embodiments, the oligonucleotide may be designed to promote stability of an mRNA. In some embodiments, the oligonucleotide may be designed to promote translation of an mRNA. In some embodiments, an oligonucleotide may be designed to promote stability and promote translation of an mRNA. In some embodiments, an oligonucleotide may be a guide nucleic acid (e.g., guide RNA) for directing activity of an enzyme (e.g., a gene editing enzyme). In some embodiments, a guide nucleic acid may direct an enzyme to delete the entirety or a part of a mutated DMD allele (e.g., to facilitate in-frame exon skipping). In some embodiments, the oligonucleotide may be designed to target repressive regulators of DMD expression, e.g., miR-31. Other examples of oligonucleotides are provided herein. It should be appreciated that, in some embodiments, oligonucleotides in one format (e.g., antisense oligonucleotides) may be suitably adapted to another format (e.g., siRNA oligonucleotides) by incorporating functional sequences (e.g., antisense strand sequences) from one format to the other format.

Examples of oligonucleotides useful for targeting DMD are provided in U.S. Patent Application Publication US20100130591A1, published on May 27, 2010, entitled "MULTIPLE EXON SKIPPING COMPOSITIONS FOR DMD"; U.S. Pat. No. 8,361,979, issued Jan. 29, 2013, entitled "MEANS AND METHOD FOR INDUCING EXON-SKIPPING"; U.S. Patent Application Publication 20120059042, published Mar. 8, 2012, entitled "METHOD FOR EFFICIENT EXON (44) SKIPPING IN DUCHENNE MUSCULAR DYSTROPHY AND ASSOCIATED MEANS; U.S. Patent Application Publication 20140329881, published Nov. 6, 2014, entitled "EXON SKIPPING COMPOSITIONS FOR TREATING MUSCULAR DYSTROPHY"; U.S. Pat. No. 8,232,384, issued Jul. 31, 2012, entitled "ANTISENSE OLIGONUCLEOTIDES FOR INDUCING EXON SKIPPING AND METHODS OF USE THEREOF"; U.S. Patent Application Publication 20120022134A1, published Jan. 26, 2012, entitled "METHODS AND MEANS FOR EFFICIENT SKIPPING OF EXON 45 IN DUCHENNE MUSCULAR DYSTROPHY PRE-MRNA; U.S. Patent Application Publication 20120077860, published Mar. 29, 2012, entitled "ADENO-ASSOCIATED VIRAL VECTOR FOR EXON SKIPPING IN A GENE ENCODING A DISPENSABLE DOMAN PROTEIN"; U.S. Pat. No. 8,324,371, issued Dec. 4, 2012, entitled "OLIGOMERS"; U.S. Pat. No. 9,078,911, issued Jul. 14, 2015, entitled "ANTISENSE OLIGONUCLEOTIDES"; U.S. Pat. No. 9,079,934, issued Jul. 14, 2015, entitled "ANTISENSE NUCLEIC ACIDS"; U.S. Pat. No. 9,034,838, issued May 19, 2015, entitled "MIR-31 IN DUCHENNE MUSCULAR DYSTROPHY THERAPY"; and International Patent Publication WO2017062862A3, published Apr. 13, 2017, entitled "OLIGONUCLEOTIDE COMPOSITIONS AND METHODS THEREOF"; the contents of each of which are incorporated herein in their entireties.

Table 14 provides non-limiting examples of sequences of oligonucleotides that are useful for targeting DMD, e.g., for exon skipping. In some embodiments, an oligonucleotide may comprise any sequence provided in Table 14.

TABLE 14

Oligonucleotide sequences for targeting DMD.

| EXON | SEQ ID NO: | SEQUENCE |
|---|---|---|
| 8 | 151 | CUUCCUGGAUGGCUUCAAU |
| 8 | 152 | GUACAUUAAGAUGGACUUC |
| 8 | 153 | UAUCUGGAUAGGUGGUAUCAAGAUCUGUAA |
| 8 | 154 | AUGUAACUGAAAAUGUUCUUCUUUA |

TABLE 14-continued

Oligonucleotide sequences for targeting DMD.

| EXON | SEQ ID NO: | SEQUENCE |
|---|---|---|
| 8 | 155 | UGGAUAGGUGGUAUCAACAUCUGUAAGCAC |
| 8 | 156 | GAUAGGUGGUAUCAACAUCUGU |
| 8 | 157 | UAUCUGGAUAGGUGGUAUCAACAUCUGUAA |
| 8 | 158 | AAACUUGGAAGAGUGAUGUGAUGUA |
| 8 | 159 | GCUCACUUGUUGAGGCAAAACUUGGAA |
| 8 | 160 | GCCUUGGCAACAUUUCCACUUCCUG |
| 8 | 161 | UACACACUUUACCUGUUGAGAAUAG |
| 8 | 162 | GAUAGGUGGUAUCAACAUCUGUAA |
| 8 | 163 | GAUAGGUGGUAUCAACAUCUG |
| 8 | 164 | GAUAGGUGGUAUCAACAUCUGUAAG |
| 8 | 165 | GGUGGUAUCAACAUCUGUAA |
| 8 | 166 | GUAUCAACAUCUGUAAGCAC |
| 23 | 167 | CGGCUAAUUUCAGAGGGCGCUUUCUUNGAC |
| 23 | 168 | ACAGUGGUGCUGAGAUAGUAUAGGCC |
| 23 | 169 | UAGGCCACUUUGUUGCUCUUGC |
| 23 | 170 | UUCAGAGGGCGCUUUCUUC |
| 23 | 171 | GGCCAAACCUCGGCUUACCUGAAAU |
| 23 | 172 | GGCCAAACCUCGGCUUACCU |
| 35 | 173 | UCUUCAGGUGCACCUUCUGUUUCUCAAUCU |
| 35 | 174 | UCUGUGAUACUCUUCAGGUGCACCUUCUGU |
| 35 | 175 | UCUUCUGCUCGGGAGGUGACA |
| 35 | 176 | CCAGUUACUAUUCAGAAGAC |
| 35 | 177 | UCUUCAGGUGCACCUUCUGU |
| 43 | 178 | UGCUGCUGUCUUCUUGCU |
| 43 | 179 | UUGUUAACUUUUUCCCAUU |
| 43 | 180 | UGUUAACUUUUUCCCAUUGG |
| 43 | 181 | CAUUUUGUUAACUUUUUCCC |
| 43 | 182 | CUGUAGCUUCACCCUUUCC |
| 43 | 183 | GAGAGCUUCCUGUAGCUUCACCCUUU |
| 43 | 184 | UCCUGUAGCUUCACCCUUUCCACAGGCG |
| 43 | 185 | UGUGUUACCUACCCUUGUCG |
| 43 | 186 | UAGACUAUCUUUUAUAUUCUGUAAUAU |
| 43 | 187 | GAGAGCUUCCUGUAGCUUCACCCUUUCCA |
| 43 | 188 | UUCCUGUAGCUUCACCCUUUCCACAGGCGUU |
| 43 | 189 | AGCUUCCUGUAGCUUCACCCUUU |
| 43 | 190 | GGAGAGAGCUUCCUGUAGCUUCACCCUUU |
| 43 | 191 | GAGAGCUUCCUGUAGCUUCACCC |
| 43 | 192 | UAUGUGUUACCUACCCUUGUCGGUC |
| 43 | 193 | GGAGAGAGCUUCCUGUAGCU |
| 43 | 194 | UCACCCUUUCCACAGGCGUUGCA |
| 43 | 195 | GCUGGGAGAGAGCUUCCUGUAGCUUCAC |
| 43 | 196 | UGUUACCUACCCUUGUCGGUCCUUGUAC |
| 43 | 197 | CUGCUGUCUUCUUGCUAUGAAUAAUGUC |
| 43 | 198 | GGCGUUGCACUUUGCAAUGCUGCUGUCU |
| 43 | 199 | UUGGAAAUCAAGCUGGGAGAGAGCUUCC |
| 43 | 200 | CUACCCUUGUCGGUCCUUGUACAUUUUG |
| 43 | 201 | GUCAAUCCGACCUGAGCUUUGUUGUAGA |
| 43 | 202 | CUUGCUAUGAAUAAUGUCAAUCCGACC |
| 43 | 203 | UAUAUGUGUUACCUACCCUUGUCGGUCC |
| 43 | 204 | AAUCAGCUGGGAGAGAGCUUCCUGUAGCU |
| 43 | 205 | UCGUUCUUCUGUCGUCGUAACGUUUC |
| 44 | 206 | UUUGUGUCUUUCUGAGAAAC |
| 44 | 207 | AAAGACUUACCUUAAGAUAC |
| 44 | 208 | AUCUGUCAAAUCGCCUGCAG |
| 44 | 209 | CGCCGCCAUUUCUCAACAG |
| 44 | 210 | UUUGUAUUUAGCAUGUUCCC |
| 44 | 211 | CCGCCAUUUCUCAACAG |
| 44 | 212 | UUCUCAGGAAUUUGUGUCUUU |
| 44 | 213 | GACAACUCUUU |
| 44 | 214 | UCAGCUUCGUUAGCCACUG |
| 44 | 215 | UGUUCAGCUUCUGUUAGCCACUGA |
| 44 | 216 | CUGUUCAGCUUCUGUUAGCCACUGAUU |
| 44 | 217 | UUCUCAACAGAUCUGUCAAAUCGCCUGCAG |
| 44 | 218 | GCCACUGAUUAAAUAUCUUUAUAUC |
| 44 | 219 | UCUGUUAGCCACUGAUUAAAUAUCUUUAUA |
| 44 | 220 | GAGAAACUGUUCAGCUUCUGUUAGCCACUGA |
| 44 | 221 | UCUUUCUGAGAAACUGUUCAGCUUCUGUUAG |
| 44 | 222 | CAGAUCUGUCAAAUCGCCUGCAGGUA |
| 44 | 223 | CAACAGAUCUGUCAAAUCGCCUGCAG |
| 44 | 224 | AAACUGUUCAGCUUCUGUUAGCCACUGAUUAAA |
| 44 | 225 | GAAACUGUUCAGCUUCUGUUAGCCACUGAUU |
| 44 | 226 | AAACUGUUCAGCUUCUGUUAGCCACUGA |
| 44 | 227 | UGAGAAACUGUUCAGCUUCUGUUAGCCA |
| 44 | 228 | UUCUGAGAAACUGUUCAGCUUCUGUUAGCCAC |

TABLE 14-continued

Oligonucleotide sequences for targeting DMD.

| EXON | SEQ ID NO: | SEQUENCE |
|---|---|---|
| 44 | 229 | UUCUGAGAAACUGUUCAGCUUCUGUU |
| 44 | 230 | GAUCUGUCAAAUCGCCUGCAGGUAA |
| 44 | 23 | AUAAUGAAAACGCCGCCAUUUCUCA |
| 44 | 232 | AAACUGUUCAGCUUCUGUUAGCCAC |
| 44 | 233 | UUGUGUCUUUCUGAGAAACUGUUCA |
| 44 | 234 | CCAAUUCUCAGGAAUUUGUGUCUUU |
| 44 | 235 | AUCGCCUGCAGGUAAAAGCAUAUGG |
| 44 | 236 | UGAAAACGCCGCCAUUUCUCAACAGAUCUG |
| 44 | 237 | CAUAAUGAAAACGCCGCCAUUUCUCAACAG |
| 44 | 238 | UGUUCAGCUUCUGUUAGCCACUGAUUAAAU |
| 44 | 239 | CAGAUCUGUCAAAUCGCCUGCAGG |
| 44 | 240 | CAACAGAUCUGUCAAAUCGCCUGCAGG |
| 44 | 241 | CUCAACAGAUCUGUCAAAUCGCCUGCAGG |
| 44 | 242 | GAUCUGUCAAAUCGCCUGCAGGU |
| 44 | 243 | GAUCUGUCAAAUCGCCUGCAGG |
| 44 | 244 | GAUCUGUCAAAUCGCCUGCAG |
| 44 | 245 | CAGAUCUGUCAAAUCGCCUGCAGGU |
| 44 | 246 | CAGAUCUGUCAAAUCGCCUGCAG |
| 44 | 247 | GUGUCUUUCUGAGAAACUGUUCAGC |
| 44 | 248 | GAGAAACUGUUCAGCUUCUGUUAGCCAC |
| 44 | 249 | GAAACUGUUCAGCUUCUGUUAGCCACUG |
| 44 | 250 | CUGUUCAGCUUCUGUUAGCCACUG |
| 44 | 251 | AUCUGUCAAAUCGCCUGCAGGUAAAAG |
| 44 | 252 | GAUCUGUCAAAUCGCCUGCAGGUAAAAGC |
| 44 | 253 | CACCGAUUGUCUUCGA |
| 44 | 254 | CCCUUGUACGAUUUAUG |
| 44 | 255 | UCUGUGUUUAAGGACUCU |
| 45 | 256 | GCUGAAUUAUUCUUCCCC |
| 45 | 257 | UUUUUCGUCUGACAGCUG |
| 45 | 258 | UCUGUUUUGAGGAUUGC |
| 45 | 259 | CCACCGCAGAUUCAGGC |
| 45 | 260 | GCCCAAUGCCAUCCUGG |
| 45 | 261 | UUUGCAGACCUCCUGCC |
| 45 | 262 | CAGUUUGCCGCUGCCCA |
| 45 | 263 | GUUGCAUUCAAUGUUCUGAC |
| 45 | 264 | AUUUUUCCUGUAGAAUACUGG |
| 45 | 265 | GCUGCCCAAUGCGAUCCUGGAGUUCCUGUAAGAU |
| 45 | 266 | GCUGCCCAAUGCCAUCCUGGAGUUCCUG |
| 45 | 267 | GCUGCCCAAUGCCAUCCUGGAGUUCCUGUAA |
| 45 | 268 | CAAUGCCAUCCUGGAGUUCCUGUAAGAUACC |
| 45 | 269 | GCUGCCCAAUGCCAUCCUGGAGUUCCUGUAAG |
| 45 | 270 | CCAAUGCCAUCCUGGAGUUCCUGUAAGAUA |
| 45 | 271 | UUGCCGCUGCCCAAUGCCAUCCUGGAGUUCCUGUAAGAU |
| 45 | 272 | GCUGCCCAAUGCCAUCCUGGAGUUCCUGUAAGAU |
| 45 | 273 | CAAUGCCAUCCUGGAGUUCCUGUAAGA |
| 45 | 274 | CAGUUUGCCGCUGCCCAAUGCCAUCC |
| 45 | 275 | CUUCCCCAGUUGCAUUCAAUGUUC |
| 45 | 276 | CUGGCAUCUGUUUUGAGGAUUG |
| 45 | 277 | UUAGAUCUGUCGCCCUACCU |
| 45 | 278 | GCUGCCCAAUGCCAUCCUGGAGUUCCUGUAAGAUACCAA |
| 45 | 279 | GCCCAAUGCCAUCCUGGAGUUCCUGUAAGAUACC |
| 45 | 280 | CAUCCUGGAGUUCCUGUAAGAUACC |
| 45 | 281 | UGCCAUCCUGGAGUUCCUGUAAGAUACC |
| 45 | 282 | UGCCAUCCUGGAGUUCCUGUAAGAU |
| 45 | 283 | CAAUGCCAUCCUGGAGUUCCUGUAAGAU |
| 45 | 284 | GCCCAAUGCCAUCCUGGAGUUCCUGUAAGAU |
| 45 | 285 | GCCCAAUGCCAUCCUGGAGUUCCUGUAA |
| 45 | 286 | GCCGCUGCCCAAUGACAUCCUGGAGUUCCUGUAA |
| 45 | 287 | GCCAUCCUGGAGUUCCUGUAAGAUA |
| 45 | 288 | CCAAUGCCAUCCUGGAGUUCCUGUA |
| 45 | 289 | CUGACAACAGUUUGCCGCUGCCCAA |
| 45 | 290 | UUUGAGGAUUGCUGAAUUAUUCUU |
| 45 | 291 | CAGUUUGCCGCUGCCCAAUGCCAUCCUGGA |
| 45 | 292 | UUGCCGCUGCCCAAUGCCAUCCUGGAGUUC |
| 45 | 293 | UUUGCCGCUGCCCAAUGCCAUCCUG |
| 45 | 294 | CCAAUGCCAUCCUGGAGUUCCU |
| 45 | 295 | CCCAAUGCCAUCCUGGAGUUCCUGUAAGA |
| 45 | 296 | CCGCUGCCCAAUGCCAUCCUGGAGUUCC |
| 45 | 297 | CCCAAUGCCAUCCUGGAGUUCCUGUAAGAU |
| 45 | 298 | CCGCUGCCCAAUGCCAUCCUGGAGUUCCUG |
| 45 | 299 | UGCCCAAUGCCAUCCUGGAGUUCCUGUAAG |
| 45 | 300 | CCCAAUGCCAUCCUGGAGUUCCUGUAAG |
| 45 | 301 | UGCCCAAUGCCAUCCUGGAGUUCCUGUA |
| 45 | 302 | CAAUGCCAUCCUGGAGUUCCUG |

TABLE 14-continued

Oligonucleotide sequences for targeting DMD.

| EXON | SEQ ID NO: | SEQUENCE |
|---|---|---|
| 45 | 303 | GCCGCUGCCCAAUGCCAUCCUGGAGUUCCUG |
| 45 | 304 | AUUAGAUCUGUCGCCCUACCUCUUUUUUC |
| 45 | 305 | UGUCGCCCUACCUCUUUUUUCUGUCUG |
| 45 | 306 | GCCCAAUGCCAUCCUGGAGUUCCUG |
| 55 | 307 | AGCCUCUCGCUCACUCACCCUGCAAAGGA |
| 50 | 308 | CCACUCAGAGCUCAGAUCUUCUAACUUCC |
| 50 | 309 | CUUCCACUCAGAGCUCAGAUCUUCUAA |
| 50 | 310 | GGGAUCCAGUAUACUUACAGGCUCC |
| 50 | 311 | CUCAGAGCUCAGAUCUU |
| 50 | 312 | GGCUGCUUUGCCCUC |
| 50 | 313 | CUCAGAUCUUCUAACUUCCUCUUUAAC |
| 50 | 314 | CUCAGAGCUCAGAUCUUCUAACUUCCUCU |
| 50 | 315 | CGCCUUCCACUCAGAGCUCAGAUCUUC |
| 50 | 316 | UCAGCUCUUGAAGUAAACGGUUUACCG |
| 50 | 317 | UUUGCCCUCAGCUCUUGAAGUAAACGG |
| 50 | 318 | GGCUGCUUUGCCCUCAGCUCUUGAAGU |
| 50 | 319 | CAGGAGCUAGGUCAGGCUGCUUUGCC |
| 50 | 320 | UCCAAUAGUGGUCAGUCCAGGAGCU |
| 50 | 321 | AAAGAGAAUGGGAUCCAGUAUACUUAC |
| 50 | 322 | AAAUAGCUAGAGCCAAAGAGAAUGGGA |
| 50 | 323 | GGCUGCUUUGCCCUCAGCUCUUGAAGUAAACGG |
| 50 | 324 | AGGCUGCUUUGCCCUCAGCUCUUGAAGUAA |
| 50 | 325 | GUCAGGCUGCUUUGCCCUCAGCUCUUGAAG |
| 50 | 326 | AGGUCAGGCUGCUUUGCCCUCAGCUCUUGA |
| 50 | 327 | CAGAGCUCAGAUCUUCUAACUUCCU |
| 50 | 328 | CUUACAGGCUCCAAUAGUGGUCAGU |
| 50 | 329 | AUGGGAUCCAGUAUACUUACAGGCU |
| 50 | 330 | AGAGAAUGGGAUCCAGUAUACUUAC |
| 50 | 331 | AACUUCCUCUUUAACAGAAAAGCAUAC |
| 50 | 332 | GAGCCUCUCGCUCACUCACCCUGCAAAGGA |
| 51 | 333 | CUCAUACCUUCUGCUUGAUGAUC |
| 51 | 334 | UCAAGGAAGAUGGCAUUUCU |
| 51 | 335 | GAAAGCCAGUCGGUAAGUUC |
| 51 | 336 | CACCCACCAUCACCC |
| 51 | 337 | CCUCUGUGAUUUUAUAACUUGAU |
| 51 | 338 | UGAUAUCCUCAAGGUCACCC |
| 51 | 339 | GGUACCUCCAACAUCAAGGAAGAUGGCAUU |
| 51 | 340 | AUUUCUAGUUUGGAGAUGGCAGUUUC |
| 51 | 341 | CAUCAAGGAAGAUGGCAUUUCUAGUU |
| 51 | 342 | GAGCAGGUACCUCCAACAUCAAGGAA |
| 51 | 343 | CUCCAACAUCAAGGAAGAUGGCAUUUCUAG |
| 51 | 344 | ACCAGAGUAACAGUCUGAGUAGGAG |
| 51 | 345 | CACCAGAGUAACAGUCUGAGUAGGA |
| 51 | 346 | UCACCAGAGUAACAGUCUGAGUAGG |
| 51 | 347 | GUCACCAGAGUAACAGUCUGAGUAG |
| 51 | 348 | ACCAGAGUAACAGUCUGAGUAGGAGC |
| 51 | 349 | UUCUGUCCAAGCCCGGUUGAAAUC |
| 51 | 350 | ACAUCAAGGAAGAUGGCAUUUCUAGUUUGG |
| 51 | 351 | ACAUCAAGGAAGAUGGCAUUUCUAG |
| 51 | 352 | AUCAUUUUUUCUCAUACCUUCUGCU |
| 51 | 353 | CACCCACCAUCACCCUCUGUG |
| 51 | 354 | AUCAUCUCGUUGAUAUCCUCAA |
| 51 | 355 | CUCCAACAUCAAGGAAGAUGGCAUUUCU |
| 51 | 356 | CAUCAAGGAAGAUGGCAUUUCUAGU |
| 51 | 357 | AUCAUUUUUUCUCAUACCUUCUGCUAGGAGCUAAAA |
| 52 | 358 | UUGCUGGUCUUGUUUUUC |
| 52 | 359 | CCGUAAUGAUUGUUCU |
| 52 | 360 | GCUGGUCUUGUUUUUCAA |
| 52 | 361 | UGGUCUUGUUUUUCAAAUUU |
| 52 | 362 | GUCUUGUUUUUCAAAUUUUG |
| 52 | 363 | CUUGUUUUUCAAAUUUUGGG |
| 52 | 364 | UGUUUUUCAAAUUUUGGGC |
| 52 | 365 | UCCAACUGGGGACGCCUCUGUUCCAAAUCCUGC |
| 52 | 366 | UCCUGCAUUGUUGCCUGUAAG |
| 52 | 367 | UCCAACUGGGGACGCCUCUGUUCCAAAUCC |
| 52 | 368 | ACUGGGGACGCCUCUGUUCCA |
| 52 | 369 | CCGUAAUGAUUGUUCUAGCC |
| 52 | 370 | UGUUAAAAAACUUACUUCGA |
| 53 | 371 | CUGUUGCCUCCGGUUCUG |
| 53 | 372 | UUGGCUCUGGCCUGUCCU |
| 53 | 373 | UUCAACUGUUGCCUCCGGUUCUGAAGGUGUUCU |
| 53 | 374 | UACUUCAUCCCACUGAUUCUGAAUU |
| 53 | 375 | CUGAAGGUGUUCUUGUACUUCAUCC |
| 53 | 376 | CUGUUGCCUCCGGUUCUGAAGGUGU |

TABLE 14-continued

Oligonucleotide sequences for targeting DMD.

| EXON | SEQ ID NO: | SEQUENCE |
|---|---|---|
| 53 | 377 | CUGUUGCCUCCGGUUCUGAAGGUGUUCUUG |
| 53 | 378 | CAACUGUUGCCUCCGGUUCUGAAGGUGUUC |
| 53 | 379 | UUGCCUCCGGUUCUGAAGGUGUUCUUGUAC |
| 53 | 380 | GUUGCCUCCGGUUCUGAAGGUGUUC |
| 53 | 381 | CUCCGGUUCUGAAGGUGUUCUUG |
| 53 | 382 | CUCCGGUUCUGAAGGUGUUCUU |
| 53 | 383 | CUCCGGUUCUGAAGGUGUUCU |
| 53 | 384 | CUCCGGUUCUGAAGGUGUUC |
| 53 | 385 | CUCCGGUUCUGAAGGUGUU |
| 53 | 386 | CAUUCAACUGUUGCCUCCGGUUCUG |
| 53 | 387 | CUGUUGCCUCCGGUUCUGAAGGUG |
| 53 | 388 | CAUUCAACUGUUGCCUCCGGUUCUGAAGGUG |
| 53 | 389 | UACUAACCUUGGUUUCUGUGA |
| 53 | 390 | UGUAUAGGGACCCUCCUUCCAUGACUC |
| 53 | 391 | CUAACCUUGGUUUCUGUGAUUUUCU |
| 53 | 392 | GGUAUCUUUGAUACUAACCUUGGUUUC |
| 53 | 393 | AUUCUUUCAACUAGAAUAAAAG |
| 53 | 394 | GAUUCUGAAUUCUUUCAACUAGAAU |
| 53 | 395 | AUCCCACUGAUUCUGAAUUC |
| 53 | 396 | AACCGAGACCGGACAGGAUUCU |
| 53 | 397 | GGAAGCUAAGGAAGAAGCUGAGCAGG |
| 55 | 398 | CUGUUGCAGUAAUCUAUGAG |
| 55 | 399 | UGCCAUUGUUUCAUCAGCUCUUU |
| 55 | 400 | UGCAGUAAUCUAUGAGUUUC |
| 55 | 401 | UCCUGUAGGACAUUGGCAGU |
| 55 | 131 | GAGUCUUCUAGGAGCCUU |

In some embodiments, an oligonucleotide useful for targeting DMD (e.g., for exon skipping) targets a region of a DMD RNA (e.g., the Dp427m transcript of SEQ ID NO: 2239). In some embodiments, an oligonucleotide useful for targeting DMD (e.g., for exon skipping) comprises a region of complementarity to a DMD RNA (e.g., the Dp427m transcript of SEQ ID NO: 2239). In some embodiments, an oligonucleotide useful for targeting DMD (e.g., for exon skipping) comprises a region of complementarity to an exon of a DMD RNA (e.g., any one of SEQ ID NOs: 2240-2250). Examples of DMD RNA sequences and exon sequences are provided below.

*Homo sapiens* Dystrophin (DMD), Transcript Variant Dp427m, mRNA (NCBI Reference Sequence: NM_004006.2)

(SEQ ID NO: 2239)
TCCTGGCATCAGTTACTGTGTTGACTCACTCAGTGTTGGGATCACTCACTTTCCCCCTACAGGACTC

AGATCTGGGAGGCAATTACCTTCGGAGAAAAACGAATAGGAAAAACTGAAGTGTTACTTTTTTTAAA

GCTGCTGAAGTTTGTTGGTTTCTCATTGTTTTTAAGCCTACTGGAGCAATAAAGTTTGAAGAACTTT

TACCAGGTTTTTTTTATCGCTGCCTTGATATACACTTTTCAAAATGCTTTGGTGGGAAGAAGTAGAG

GACTGTTATGAAAGAGAAGATGTTCAAAAGAAAACATTCACAAAATGGGTAAATGCACAATTTTCTA

AGTTTGGGAAGCAGCATATTGAGAACCTCTTCAGTGACCTACAGGATGGGAGGCGCCTCCTAGACCT

CCTCGAAGGCCTGACAGGGCAAAAACTGCCAAAAGAAAAAGGATCCACAAGAGTTCATGCCCTGAAC

AATGTCAACAAGGCACTGCGGGTTTTGCAGAACAATAATGTTGATTTAGTGAATATTGGAAGTACTG

ACATCGTAGATGGAAATCATAAACTGACTCTTGGTTTGATTTGGAATATAATCCTCCACTGGCAGGT

CAAAAATGTAATGAAAATATCATGGCTGGATTGCAACAAACCAACAGTGAAAAGATTCTCCTGAGC

TGGGTCCGACAATCAACTCGTAATTATCCACAGGTTAATGTAATCAACTTCACCACCAGCTGGTCTG

ATGGCCTGGCTTTGAATGCTCTCATCCATAGTCATAGGCCAGACCTATTTGACTGGAATAGTGTGGT

TTGCCAGCAGTCAGCCACACAACGACTGGAACATGCATTCAACATCGCCAGATATCAATTAGGCATA

GAGAAACTACTCGATCCTGAAGATGTTGATACCACCTATCCAGATAAGAAGTCCATCTTAATGTACA

TCACATCACTCTTCCAAGTTTTGCCTCAACAAGTGAGCATTGAAGCCATCCAGGAAGTGGAAATGTT

GCCAAGGCCACCTAAAGTGACTAAAGAAGAACATTTTCAGTTACATCATCAAATGCACTATTCTCAA

CAGATCACGGTCAGTCTAGCACAGGGATATGAGAGAACTTCTTCCCCTAAGCCTCGATTCAAGAGCT

-continued

```
ATGCCTACACACAGGCTGCTTATGTCACCACCTCTGACCCTACACGGAGCCCATTTCCTTCACAGCA
TTTGGAAGCTCCTGAAGACAAGTCATTTGGCAGTTCATTGATGGAGAGTGAAGTAAACCTGGACCGT
TATCAAACAGCTTTAGAAGAAGTATTATCGTGGCTTCTTTCTGCTGAGGACACATTGCAAGCACAAG
GAGAGATTTCTAATGATGTGGAAGTGGTGAAAGACCAGTTTCATACTCATGAGGGGTACATGATGGA
TTTGACAGCCCATCAGGGCCGGGTTGGTAATATTCTACAATTGGGAAGTAAGCTGATTGGAACAGGA
AAATTATCAGAAGATGAAGAAACTGAAGTACAAGAGCAGATGAATCTCCTAAATTCAAGATGGGAAT
GCCTCAGGGTAGCTAGCATGGAAAAACAAAGCAATTTACATAGAGTTTTAATGGATCTCCAGAATCA
GAAACTGAAAGAGTTGAATGACTGGCTAACAAAAACAGAAGAAAGAACAAGGAAAATGGAGGAAGAG
CCTCTTGGACCTGATCTTGAAGACCTAAAACGCCAAGTACAACAACATAAGGTGCTTCAAGAAGATC
TAGAACAAGAACAAGTCAGGGTCAATTCTCTCACTCACATGGTGGTGGTAGTTGATGAATCTAGTGG
AGATCACGCAACTGCTGCTTTGGAAGAACAACTTAAGGTATTGGGAGATCGATGGGCAAACATCTGT
AGATGGACAGAAGACCGCTGGGTTCTTTTACAAGACATCCTTCTCAAATGGCAACGTCTTACTGAAG
AACAGTGCCTTTTTAGTGCATGGCTTTCAGAAAAAGAAGATGCAGTGAACAAGATTCACACAACTGG
CTTTAAAGATCAAAATGAAATGTTATCAAGTCTTCAAAAACTGGCCGTTTTAAAAGCGGATCTAGAA
AAGAAAAAGCAATCCATGGGCAAACTGTATTCACTCAAACAAGATCTTCTTTCAACACTGAAGAATA
AGTCAGTGACCCAGAAGACGGAAGCATGGCTGGATAACTTTGCCCGGTGTTGGGATAATTTAGTCCA
AAAACTTGAAAAGAGTACAGCACAGATTTCACAGGCTGTCACCACCACTCAGCCATCACTAACACAG
ACAACTGTAATGGAAACAGTAACTACGGTGACCACAAGGGAACAGATCCTGGTAAAGCATGCTCAAG
AGGAACTTCCACCACCACCTCCCCAAAAGAAGAGGCAGATTACTGTGGATTCTGAAATTAGGAAAAG
GTTGGATGTTGATATAACTGAACTTCACAGCTGGATTACTCGCTCAGAAGCTGTGTTGCAGAGTCCT
GAATTTGCAATCTTTCGGAAGGAAGGCAACTTCTCAGACTTAAAAGAAAAAGTCAATGCCATAGAGC
GAGAAAAAGCTGAGAAGTTCAGAAAACTGCAAGATGCCAGCAGATCAGCTCAGGCCCTGGTGGAACA
GATGGTGAATGAGGGTGTTAATGCAGATAGCATCAAACAAGCCTCAGAACAACTGAACAGCCGGTGG
ATCGAATTCTGCCAGTTGCTAAGTGAGAGACTTAACTGGCTGGAGTATCAGAACAACATCATCGCTT
TCTATAATCAGCTACAACAATTGGAGCAGATGACAACTACTGCTGAAAACTGGTTGAAAATCCAACC
CACCACCCCATCAGAGCCAACAGCAATTAAAAGTCAGTTAAAAATTTGTAAGGATGAAGTCAACCGG
CTATCAGGTCTTCAACCTCAAATTGAACGATTAAAAATTCAAAGCATAGCCCTGAAAGAGAAAGGAC
AAGGACCCATGTTCCTGGATGCAGACTTTGTGGCCTTTACAAATCATTTTAAGCAAGTCTTTTCTGA
TGTGCAGGCCAGAGAGAAAGAGCTACAGACAATTTTTGACACTTTGCCACCAATGCGCTATCAGGAG
ACCATGAGTGCCATCAGGACATGGGTCCAGCAGTCAGAAACCAAACTCTCCATACCTCAACTTAGTG
TCACCGACTATGAAATCATGGAGCAGAGACTCGGGGAATTGCAGGCTTTACAAAGTTCTCTGCAAGA
GCAACAAAGTGGCCTATACTATCTCAGCACCACTGTGAAAGAGATGTCGAAGAAAGCGCCCTCTGAA
ATTAGCCGGAAATATCAATCAGAATTTGAAGAAATTGAGGGACGCTGGAAGAAGCTCTCCTCCCAGC
TGGTTGAGCATTGTCAAAAGCTAGAGGAGCAAATGAATAAACTCCGAAAAATTCAGAATCACATACA
AACCCTGAAGAAATGGATGGCTGAAGTTGATGTTTTTCTGAAGGAGGAATGGCCTGCCCTTGGGGAT
TCAGAAATTCTAAAAAAGCAGCTGAAACAGTGCAGACTTTTAGTCAGTGATATTCAGACAATTCAGC
CCAGTCTAAACAGTGTCAATGAAGGTGGGCAGAAGATAAAGAATGAAGCAGAGCCAGAGTTTGCTTC
GAGACTTGAGACAGAACTCAAAGAACTTAACACTCAGTGGGATCACATGTGCCAACAGGTCTATGCC
AGAAAGGAGGCCTTGAAGGGAGGTTTGGAGAAAACTGTAAGCCTCCAGAAAGATCTATCAGAGATGC
ACGAATGGATGACACAAGCTGAAGAAGAGTATCTTGAGAGAGATTTTGAATATAAAACTCCAGATGA
ATTACAGAAAGCAGTTGAAGAGATGAAGAGAGCTAAAGAAGAGGCCCAACAAAAAGAAGCGAAAGTG
```

-continued

```
AAACTCCTTACTGAGTCTGTAAATAGTGTCATAGCTCAAGCTCCACCTGTAGCACAAGAGGCCTTAA

AAAAGGAACTTGAAACTCTAACCACCAACTACCAGTGGCTCTGCACTAGGCTGAATGGGAAATGCAA

GACTTTGGAAGAAGTTTGGGCATGTTGGCATGAGTTATTGTCATACTTGGAGAAAGCAAACAAGTGG

CTAAATGAAGTAGAATTTAAACTTAAAACCACTGAAAACATTCCTGGCGGAGCTGAGGAAATCTCTG

AGGTGCTAGATTCACTTGAAAATTTGATGCGACATTCAGAGGATAACCCAAATCAGATTCGCATATT

GGCACAGACCCTAACAGATGGCGGAGTCATGGATGAGCTAATCAATGAGGAACTTGAGACATTTAAT

TCTCGTTGGAGGGAACTACATGAAGAGGCTGTAAGGAGGCAAAAGTTGCTTGAACAGAGCATCCAGT

CTGCCCAGGAGACTGAAAAATCCTTACACTTAATCCAGGAGTCCCTCACATTCATTGACAAGCAGTT

GGCAGCTTATATTGCAGACAAGGTGGACGCAGCTCAAATGCCTCAGGAAGCCCAGAAAATCCAATCT

GATTTGACAAGTCATGAGATCAGTTTAGAAGAAATGAAGAAACATAATCAGGGGAAGGAGGCTGCCC

AAAGAGTCCTGTCTCAGATTGATGTTGCACAGAAAAAATTACAAGATGTCTCCATGAAGTTTCGATT

ATTCCAGAAACCAGCCAATTTTGAGCAGCGTCTACAAGAAAGTAAGATGATTTTAGATGAAGTGAAG

ATGCACTTGCCTGCATTGGAAACAAAGAGTGTGGAACAGGAAGTAGTACAGTCACAGCTAAATCATT

GTGTGAACTTGTATAAAAGTCTGAGTGAAGTGAAGTCTGAAGTGGAAATGGTGATAAAGACTGGACG

TCAGATTGTACAGAAAAAGCAGACGGAAAATCCCAAAGAACTTGATGAAAGAGTAACAGCTTTGAAA

TTGCATTATAATGAGCTGGGAGCAAAGGTAACAGAAAGAAAGCAACAGTTGGAGAAATGCTTGAAAT

TGTCCCGTAAGATGCGAAAGGAAATGAATGTCTTGACAGAATGGCTGGCAGCTACAGATATGGAATT

GACAAAGAGATCAGCAGTTGAAGGAATGCCTAGTAATTTGGATTCTGAAGTTGCCTGGGGAAAGGCT

ACTCAAAAAGAGATTGAGAAACAGAAGGTGCACCTGAAGAGTATCACAGAGGTAGGAGAGGCCTTGA

AAACAGTTTTGGGCAAGAAGGAGACGTTGGTGGAAGATAAACTCAGTCTTCTGAATAGTAACTGGAT

AGCTGTCACCTCCCGAGCAGAAGAGTGGTTAAATCTTTTGTTGGAATACCAGAAACACATGGAAACT

TTTGACCAGAATGTGGACCACATCACAAAGTGGATCATTCAGGCTGACACACTTTTGGATGAATCAG

AGAAAAAGAAACCCCAGCAAAAAGAAGACGTGCTTAAGCGTTTAAAGGCAGAACTGAATGACATACG

CCCAAAGGTGGACTCTACACGTGACCAAGCAGCAAACTTGATGGCAAACCGCGGTGACCACTGCAGG

AAATTAGTAGAGCCCCAAATCTCAGAGCTCAACCATCGATTTGCAGCCATTTCACACAGAATTAAGA

CTGGAAAGGCCTCCATTCCTTTGAAGGAATTGGAGCAGTTTAACTCAGATATACAAAAATTGCTTGA

ACCACTGGAGGCTGAAATTCAGCAGGGGGTGAATCTGAAAGAGGAAGACTTCAATAAAGATATGAAT

GAAGACAATGAGGGTACTGTAAAAGAATTGTTGCAAAGAGGAGACAACTTACAACAAAGAATCACAG

ATGAGAGAAAGCGAGAGGAAATAAAGATAAAACAGCAGCTGTTACAGACAAAACATAATGCTCTCAA

GGATTTGAGGTCTCAAAGAAGAAAAAAGGCTCTAGAAATTTCTCATCAGTGGTATCAGTACAAGAGG

CAGGCTGATGATCTCCTGAAATGCTTGGATGACATTGAAAAAAAATTAGCCAGCCTACCTGAGCCCA

GAGATGAAAGGAAATAAAGGAAATTGATCGGGAATTGCAGAAGAAGAAAGAGGAGCTGAATGCAGT

GCGTAGGCAAGCTGAGGGCTTGTCTGAGGATGGGCCGCAATGGCAGTGGAGCCAACTCAGATCCAG

CTCAGCAAGCGCTGGCGGGAAATTGAGAGCAAATTTGCTCAGTTTCGAAGACTCAACTTTGCACAAA

TTCACACTGTCCGTGAAGAAACGATGATGGTGATGACTGAAGACATGCCTTTGGAAATTTCTTATGT

GCCTTCTACTTATTTGACTGAAATCACTCATGTCTCACAAGCCCTATTAGAAGTGGAACAACTTCTC

AATGCTCCTGACCTCTGTGCTAAGGACTTTGAAGATCTCTTTAAGCAAGAGGAGTCTCTGAAGAATA

TAAAAGATAGTCTACAACAAAGCTCAGGTCGGATTGACATTATTCATAGCAAGAAGACAGCAGCATT

GCAAAGTGCAACGCCTGTGGAAAGGGTGAAGCTACAGGAAGCTCTCTCCCAGCTTGATTTCCAATGG

GAAAAAGTTAACAAAATGTACAAGGACCGACAAGGGCGATTTGACAGATCTGTTGAGAAATGGCGGC
```

-continued

```
GTTTTCATTATGATATAAAGATATTTAATCAGTGGCTAACAGAAGCTGAACAGTTTCTCAGAAAGAC

ACAAATTCCTGAGAATTGGGAACATGCTAAATACAAATGGTATCTTAAGGAACTCCAGGATGGCATT

GGGCAGCGGCAAACTGTTGTCAGAACATTGAATGCAACTGGGGAAGAAATAATTCAGCAATCCTCAA

AAACAGATGCCAGTATTCTACAGGAAAAATTGGGAAGCCTGAATCTGCGGTGGCAGGAGGTCTGCAA

ACAGCTGTCAGACAGAAAAAGAGGCTAGAAGAACAAAGAATATCTTGTCAGAATTTCAAAGAGAT

TTAAATGAATTTGTTTTATGGTTGGAGGAAGCAGATAACATTGCTAGTATCCCACTTGAACCTGGAA

AAGAGCAGCAACTAAAAGAAAAGCTTGAGCAAGTCAAGTTACTGGTGGAAGAGTTGCCCCTGCGCCA

GGGAATTCTCAAACAATTAAATGAAACTGGAGGACCCGTGCTTGTAAGTGCTCCCATAAGCCCAGAA

GAGCAAGATAAACTTGAAAATAAGCTCAAGCAGACAAATCTCCAGTGGATAAAGGTTTCCAGAGCTT

TACCTGAGAAACAAGGAGAAATTGAAGCTCAAATAAAAGACCTTGGGCAGCTTGAAAAAAAGCTTGA

AGACCTTGAAGAGCAGTTAAATCATCTGCTGCTGTGGTTATCTCCTATTAGGAATCAGTTGGAAATT

TATAACCAACCAAACCAAGAAGGACCATTTGACGTTCAGGAAACTGAAATAGCAGTTCAAGCTAAAC

AACCGGATGTGGAAGAGATTTTGTCTAAAGGGCAGCATTTGTACAAGGAAAAACCAGCCACTCAGCC

AGTGAAGAGGAAGTTAGAAGATCTGAGCTCTGAGTGGAAGGCGGTAAACCGTTTACTTCAAGAGCTG

AGGGCAAAGCAGCCTGACCTAGCTCCTGGACTGACCACTATTGGAGCCTCTCCTACTCAGACTGTTA

CTCTGGTGACACAACCTGTGGTTACTAAGGAAACTGCCATCTCCAAACTAGAAATGCCATCTTCCTT

GATGTTGGAGGTACCTGCTCTGGCAGATTTCAACCGGGCTTGGACAGAACTTACCGACTGGCTTTCT

CTGCTTGATCAAGTTATAAAATCACAGAGGGTGATGGTGGGTGACCTTGAGGATATCAACGAGATGA

TCATCAAGCAGAAGGCAACAATGCAGGATTTGGAACAGAGGCGTCCCCAGTTGGAAGAACTCATTAC

CGCTGCCCAAAATTTGAAAAACAAGACCAGCAATCAAGAGGCTAGAACAATCATTACGGATCGAATT

GAAAGAATTCAGAATCAGTGGGATGAAGTACAAGAACACCTTCAGAACCGGAGGCAACAGTTGAATG

AAATGTTAAAGGATTCAACACAATGGCTGGAAGCTAAGGAAGAAGCTGAGCAGGTCTTAGGACAGGC

CAGAGCCAAGCTTGAGTCATGGAAGGAGGGTCCCTATACAGTAGATGCAATCCAAAAGAAAATCACA

GAAACCAAGCAGTTGGCCAAAGACCTCCGCCAGTGGCAGACAAATGTAGATGTGGCAAATGACTTGG

CCCTGAAACTTCTCCGGGATTATTCTGCAGATGATACCAGAAAAGTCCACATGATAACAGAGAATAT

CAATGCCTCTTGGAGAAGCATTCATAAAAGGGTGAGTGAGCGAGAGGCTGCTTTGGAAGAAACTCAT

AGATTACTGCAACAGTTCCCCCTGGACCTGGAAAAGTTTCTTGCCTGGCTTACAGAAGCTGAAACAA

CTGCCAATGTCCTACAGGATGCTACCCGTAAGGAAAGGCTCCTAGAAGACTCCAAGGGAGTAAAAGA

GCTGATGAAACAATGGCAAGACCTCCAAGGTGAAATTGAAGCTCACACAGATGTTTATCACAACCTG

GATGAAAACAGCCAAAAAATCCTGAGATCCCTGGAAGGTTCCGATGATGCAGTCCTGTTACAAAGAC

GTTTGGATAACATGAACTTCAAGTGGAGTGAACTTCGGAAAAAGTCTCTCAACATTAGGTCCCATTT

GGAAGCCAGTTCTGACCAGTGGAAGCGTCTGCACCTTTCTCTGCAGGAACTTCTGGTGTGGCTACAG

CTGAAAGATGATGAATTAAGCCGGCAGGCACCTATTGGAGGCGACTTTCCAGCAGTTCAGAAGCAGA

ACGATGTACATAGGGCCTTCAAGAGGGAATTGAAAACTAAAGAACCTGTAATCATGAGTACTCTTGA

GACTGTACGAATATTTCTGACAGAGCAGCCTTTGGAAGGACTAGAGAAACTCTACCAGGAGCCCAGA

GAGCTGCCTCCTGAGGAGAGAGCCCAGAATGTCACTCGGCTTCTACGAAAGCAGGCTGAGGAGGTCA

ATACTGAGTGGGAAAAATTGAACCTGCACTCCGCTGACTGGCAGAGAAAATAGATGAGACCCTTGA

AAGACTCCAGGAACTTCAAGAGGCCACGGATGAGCTGGACCTCAAGCTGCGCCAAGCTGAGGTGATC

AAGGGATCCTGGCAGCCCGTGGGCGATCTCCTCATTGACTCTCTCCAAGATCACCTCGAGAAAGTCA

AGGCACTTCGAGGAGAAATTGCGCCTCTGAAAGAGAACGTGAGCCACGTCAATGACCTTGCTCGCCA

GCTTACCACTTTGGGCATTCAGCTCTCACCGTATAACCTCAGCACTCTGGAAGACCTGAACACCAGA
```

-continued

```
TGGAAGCTTCTGCAGGTGGCCGTCGAGGACCGAGTCAGGCAGCTGCATGAAGCCCACAGGGACTTTG

GTCCAGCATCTCAGCACTTTCTTTCCACGTCTGTCCAGGGTCCCTGGGAGAGAGCCATCTCGCCAAA

CAAAGTGCCCTACTATATCAACCACGAGACTCAAACAACTTGCTGGGACCATCCCAAAATGACAGAG

CTCTACCAGTCTTTAGCTGACCTGAATAATGTCAGATTCTCAGCTTATAGGACTGCCATGAAACTCC

GAAGACTGCAGAAGGCCCTTTGCTTGGATCTCTTGAGCCTGTCAGCTGCATGTGATGCCTTGGACCA

GCACAACCTCAAGCAAAATGACCAGCCCATGGATATCCTGCAGATTATTAATTGTTTGACCACTATT

TATGACCGCCTGGAGCAAGAGCACAACAATTTGGTCAACGTCCCTCTCTGCGTGGATATGTGTCTGA

ACTGGCTGCTGAATGTTTATGATACGGGACGAACAGGGAGGATCCGTGTCCTGTCTTTTAAAACTGG

CATCATTTCCCTGTGTAAAGCACATTTGGAAGACAAGTACAGATACCTTTTCAAGCAAGTGGCAAGT

TCAACAGGATTTTGTGACCAGCGCAGGCTGGGCCTCCTTCTGCATGATTCTATCCAAATTCCAAGAC

AGTTGGGTGAAGTTGCATCCTTTGGGGGCAGTAACATTGAGCCAAGTGTCCGGAGCTGCTTCCAATT

TGCTAATAATAAGCCAGAGATCGAAGCGGCCCTCTTCCTAGACTGGATGAGACTGGAACCCCAGTCC

ATGGTGTGGCTGCCCGTCCTGCACAGAGTGGCTGCTGCAGAAACTGCCAAGCATCAGGCCAAATGTA

ACATCTGCAAAGAGTGTCCAATCATTGGATTCAGGTACAGGAGTCTAAAGCACTTTAATTATGACAT

CTGCCAAAGCTGCTTTTTTTCTGGTCGAGTTGCAAAAGGCCATAAAATGCACTATCCCATGGTGGAA

TATTGCACTCCGACTACATCAGGAGAAGATGTTCGAGACTTTGCCAAGGTACTAAAAAACAAATTTC

GAACCAAAAGGTATTTTGCGAAGCATCCCCGAATGGGCTACCTGCCAGTGCAGACTGTCTTAGAGGG

GGACAACATGGAAACTCCCGTTACTCTGATCAACTTCTGGCCAGTAGATTCTGCGCCTGCCTCGTCC

CCTCAGCTTTCACACGATGATACTCATTCACGCATTGAACATTATGCTAGCAGGCTAGCAGAAATGG

AAAACAGCAATGGATCTTATCTAAATGATAGCATCTCTCCTAATGAGAGCATAGATGATGAACATTT

GTTAATCCAGCATTACTGCCAAAGTTTGAACCAGGACTCCCCCCTGAGCCAGCCTCGTAGTCCTGCC

CAGATCTTGATTTCCTTAGAGAGTGAGGAAAGAGGGGAGCTAGAGAGAATCCTAGCAGATCTTGAGG

AAGAAAACAGGAATCTGCAAGCAGAATATGACCGTCTAAAGCAGCAGCACGAACATAAAGGCCTGTC

CCCACTGCCGTCCCCTCCTGAAATGATGCCCACCTCTCCCCAGAGTCCCCGGGATGCTGAGCTCATT

GCTGAGGCCAAGCTACTGCGTCAACACAAAGGCCGCCTGGAAGCCAGGATGCAAATCCTGGAAGACC

ACAATAAACAGCTGGAGTCACAGTTACACAGGCTAAGGCAGCTGCTGGAGCAACCCCAGGCAGAGGC

CAAAGTGAATGGCACAACGGTGTCCTCTCCTTCTACCTCTCTACAGAGGTCCGACAGCAGTCAGCCT

ATGCTGCTCCGAGTGGTTGGCAGTCAAACTTCGGACTCCATGGGTGAGGAAGATCTTCTCAGTCCTC

CCCAGGACACAAGCACAGGGTTAGAGGAGGTGATGGAGCAACTCAACAACTCCTTCCCTAGTTCAAG

AGGAAGAAATACCCCTGGAAAGCCAATGAGAGAGGACACAATGTAGGAAGTCTTTTCCACATGGCAG

ATGATTTGGGCAGAGCGATGGAGTCCTTAGTATCAGTCATGACAGATGAAGAAGGAGCAGAATAAAT

GTTTTACAACTCCTGATTCCCGCATGGTTTTTATAATATTCATCAACAAAGAGGATTAGACAGTAA

GAGTTTACAAGAAATAAATCTATATTTTTGTGAAGGGTAGTGGTATTATACTGTAGATTTCAGTAGT

TTCTAAGTCTGTTATTGTTTTGTTAACAATGGCAGGTTTTACACGTCTATGCAATTGTACAAAAAAG

TTATAAGAAAACTACATGTAAAATCTTGATAGCTAAATAACTTGCCATTTCTTTATATGGAACGCAT

TTTGGGTTGTTTAAAAATTTATAACAGTTATAAAGAAAGATTGTAAACTAAAGTGTGCTTTATAAAA

AAAGTTGTTTATAAAAACCCCTAAAAACAAAACAAACACACACACACACATACACACACACA

CAAAACTTTGAGGCAGCGCATTGTTTTGCATCCTTTTGGCGTGATATCCATATGAAATTCATGGCTT
```

-continued

```
TTTCTTTTTTTGCATATTAAAGATAAGACTTCCTCTACCACCACACCAAATGACTACTACACACTGC

TCATTTGAGAACTGTCAGCTGAGTGGGGCAGGCTTGAGTTTTCATTTCATATATCTATATGTCTATA

AGTATATAAATACTATAGTTATATAGATAAAGAGATACGAATTTCTATAGACTGACTTTTTCCATTT

TTTAAATGTTCATGTCACATCCTAATAGAAAGAAATTACTTCTAGTCAGTCATCCAGGCTTACCTGC

TTGGTCTAGAATGGATTTTTCCCGGAGCCGGAAGCCAGGAGGAAACTACACCACACTAAAACATTGT

CTACAGCTCCAGATGTTTCTCATTTTAAACAACTTTCCACTGACAACGAAAGTAAAGTAAAGTATTG

GATTTTTTAAAGGGAACATGTGAATGAATACACAGGACTTATTATATCAGAGTGAGTAATCGGTTG

GTTGGTTGATTGATTGATTGATTGATACATTCAGCTTCCTGCTGCTAGCAATGCCACGATTTAGATT

TAATGATGCTTCAGTGGAAATCAATCAGAAGGTATTCTGACCTTGTGAACATCAGAAGGTATTTTTT

AACTCCCAAGCAGTAGCAGGACGATGATAGGGCTGGAGGGCTATGGATTCCCAGCCCATCCCTGTGA

AGGAGTAGGCCACTCTTTAAGTGAAGGATTGGATGATTGTTCATAATACATAAAGTTCTCTGTAATT

ACAACTAAATTATTATGCCCTCTTCTCACAGTCAAAAGGAACTGGGTGGTTTGGTTTTTGTTGCTTT

TTTAGATTTATTGTCCCATGTGGGATGAGTTTTTAAATGCCACAAGACATAATTTAAAATAAATAAA

CTTTGGGAAAAGGTGTAAAACAGTAGCCCCATCACATTTGTGATACTGACAGGTATCAACCCAGAAG

CCCATGAACTGTGTTTCCATCCTTTGCATTTCTCTGCGAGTAGTTCCACACAGGTTTGTAAGTAAGT

AAGAAAGAAGGCAAATTGATTCAAATGTTACAAAAAAACCCTTCTTGGTGGATTAGACAGGTTAAAT

ATATAAACAAACAAACAAAAATTGCTCAAAAAAGAGGAGAAAAGCTCAAGAGGAAAAGCTAAGGACT

GGTAGGAAAAAGCTTTACTCTTTCATGCCATTTTATTTCTTTTTGATTTTTAAATCATTCATTCAAT

AGATACCACCGTGTGACCTATAATTTTGCAAATCTGTTACCTCTGACATCAAGTGTAATTAGCTTTT

GGAGAGTGGGCTGACATCAAGTGTAATTAGCTTTTGGAGAGTGGGTTTTGTCCATTATTAATAATTA

ATTAATTAACATCAAACACGGCTTCTCATGCTATTTCTACCTCACTTTGGTTTTGGGGTGTTCCTGA

TAATTGTGCACACCTGAGTTCACAGCTTCACCACTTGTCCATTGCGTTATTTTCTTTTTCCTTTATA

ATTCTTTCTTTTTCCTTCATAATTTTCAAAAGAAAACCCAAAGCTCTAAGGTAACAAATTACCAAAT

TACATGAAGATTTGGTTTTTGTCTTGCATTTTTTTCCTTTATGTGACGCTGGACCTTTTCTTTACCC

AAGGATTTTTAAAACTCAGATTTAAAACAAGGGGTTACTTTACATCCTACTAAGAAGTTTAAGTAAG

TAAGTTTCATTCTAAAATCAGAGGTAAATAGAGTGCATAAATAATTTTGTTTTAATCTTTTTGTTTT

TCTTTTAGACACATTAGCTCTGGAGTGAGTCTGTCATAATATTTGAACAAAAATTGAGAGCTTTATT

GCTGCATTTTAAGCATAATTAATTTGGACATTATTTCGTGTTGTGTTCTTTATAACCACCAAGTATT

AAACTGTAAATCATAATGTAACTGAAGCATAAACATCACATGGCATGTTTTGTCATTGTTTTCAGGT

ACTGAGTTCTTACTTGAGTATCATAATATATTGTGTTTTAACACCAACACTGTAACATTTACGAATT

ATTTTTTTAAACTTCAGTTTTACTGCATTTTCACAACATATCAGACTTCACCAAATATATGCCTTAC

TATTGTATTATAGTACTGCTTTACTGTGTATCTCAATAAAGCACGCAGTTATGTTAC
```

Homo sapiens Dystrophin (DMD), Transcript Variant Dp427m, Exon 8 (Nucleotide Positions 894-1075 of NCBI Reference Sequence: NM_004006.2)

(SEQ ID NO: 2240)
```
ATGTTGATACCACCTATCCAGATAAGAAGTCCATCTTAATGTACATCACA

TCACTCTTCCAAGTTTTGCCTCAACAAGTGAGCATTGAAGCCATCCAGGA

AGTGGAAATGTTGCCAAGGCCACCTAAAGTGACTAAAGAAGAACATTTTC

AGTTACATCATCAAATGCACTATTCTCAACAG
```

Homo sapiens Dystrophin (DMD), Transcript Variant Dp427m, Exon 23 (Nucleotide Positions 3194-3406 of NCBI Reference Sequence: NM_004006.2)

(SEQ ID NO: 2241)
```
GCTTTACAAAGTTCTCTGCAAGAGCAACAAAGTGGCCTATACTATCTCAG

CACCACTGTGAAAGAGATGTCGAAGAAAGCGCCCTCTGAAATTAGCCGGA

AATATCAATCAGAATTTGAAGAAATTGAGGGACGCTGGAAGAAGCTCTCC

TCCCAGCTGGTTGAGCATTGTCAAAAGCTAGAGGAGCAAATGAATAAACT

CCGAAAAATTCAG
```

*Homo sapiens* Dystrophin (DMD), Transcript Variant Dp427m, Exon 43 (Nucleotide Positions 6362-6534 of NCBI Reference Sequence: NM_004006.2)

(SEQ ID NO: 2242)
AATATAAAAGATAGTCTACAACAAAGCTCAGGTCGGATTGACATTATTCA

TAGCAAGAAGACAGCAGCATTGCAAAGTGCAACGCCTGTGGAAAGGGTGA

AGCTACAGGAAGCTCTCTCCCAGCTTGATTTCCAATGGGAAAAAGTTAAC

AAAATGTACAAGGACCGACAAGG

*Homo sapiens* Dystrophin (DMD), Transcript Variant Dp427m, Exon 44 (Nucleotide Positions 6535-6682 of NCBI Reference Sequence: NM_004006.2)

(SEQ ID NO: 2243)
GCGATTTGACAGATCTGTTGAGAAATGGCGGCGTTTTCATTATGATATAA

AGATATTTAATCAGTGGCTAACAGAAGCTGAACAGTTTCTCAGAAAGACA

CAAATTCCTGAGAATTGGGAACATGCTAAATACAAATGGTATCTTAAG

*Homo sapiens* Dystrophin (DMD), Transcript Variant Dp427m, Exon 45 (Nucleotide Positions 6683-6858 of NCBI Reference Sequence: NM_004006.2)

(SEQ ID NO: 2244)
GAACTCCAGGATGGCATTGGGCAGCGGCAAACTGTTGTCAGAACATTGAA

TGCAACTGGGGAAGAAATAATTCAGCAATCCTCAAAAACAGATGCCAGTA

TTCTACAGGAAAAATTGGGAAGCCTGAATCTGCGGTGGCAGGAGGTCTGC

AAACAGCTGTCAGACAGAAAAAAGAG

*Homo sapiens* Dystrophin (DMD), Transcript Variant Dp427m, Exon 46 (Nucleotide Positions 6859-7006 of NCBI Reference Sequence: NM_004006.2)

(SEQ ID NO: 2245)
GCTAGAAGAACAAAAGAATATCTTGTCAGAATTTCAAAGAGATTTAAATG

AATTTGTTTTATGGTTGGAGGAAGCAGATAACATTGCTAGTATCCCACTT

GAACCTGGAAAAGAGCAGCAACTAAAAGAAAAGCTTGAGCAAGTCAAG

*Homo sapiens* Dystrophin (DMD), Transcript Variant Dp427m, Exon 50 (Nucleotide Positions 7445-7553 of NCBI Reference Sequence: NM_004006.2)

(SEQ ID NO: 2246)
AGGAAGTTAGAAGATCTGAGCTCTGAGTGGAAGGCGGTAAACCGTTTACT

TCAAGAGCTGAGGGCAAAGCAGCCTGACCTAGCTCCTGGACTGACCACTA

TTGGAGCCT

*Homo sapiens* Dystrophin (DMD), Transcript Variant Dp427m, Exon 51 (Nucleotide Positions 7554-7786 of NCBI Reference Sequence: NM_004006.2)

(SEQ ID NO: 2247)
CTCCTACTCAGACTGTTACTCTGGTGACACAACCTGTGGTTACTAAGGAA

ACTGCCATCTCCAAACTAGAAATGCCATCTTCCTTGATGTTGGAGGTACC

TGCTCTGGCAGATTTCAACCGGGCTTGGACAGAACTTACCGACTGGCTTT

CTCTGCTTGATCAAGTTATAAAATCACAGAGGGTGATGGTGGGTGACCTT

GAGGATATCAACGAGATGATCATCAAGCAGAAG

*Homo sapiens* Dystrophin (DMD), Transcript Variant Dp427m, Exon 52 (Nucleotide Positions 7787-7904 of NCBI Reference Sequence: NM_004006.2)

(SEQ ID NO: 2248)
GCAACAATGCAGGATTTGGAACAGAGGCGTCCCCAGTTGGAAGAACTCAT

TACCGCTGCCCAAAATTTGAAAAACAAGACCAGCAATCAAGAGGCTAGAA

CAATCATTACGGATCGAA

*Homo sapiens* Dystrophin (DMD), Transcript Variant Dp427m, Exon 53 (Nucleotide Positions 7905-8116 of NCBI Reference Sequence: NM_004006.2)

(SEQ ID NO: 2249)
TTGAAAGAATTCAGAATCAGTGGGATGAAGTACAAGAACACCTTCAGAAC

CGGAGGCAACAGTTGAATGAAATGTTAAAGGATTCAACACAATGGCTGGA

AGCTAAGGAAGAAGCTGAGCAGGTCTTAGGACAGGCCAGAGCCAAGCTTG

AGTCATGGAAGGAGGGTCCCTATACAGTAGATGCAATCCAAAAGAAAATC

ACAGAAACCAAG

*Homo sapiens* Dystrophin (DMD), Transcript Variant Dp427m, Exon 55 (Nucleotide Positions 8272-8461 of NCBI Reference Sequence: NM_004006.2)

(SEQ ID NO: 2250)
GGTGAGTGAGCGAGAGGCTGCTTTGGAAGAAACTCATAGATTACTGCAAC

AGTTCCCCCTGGACCTGGAAAAGTTTCTTGCCTGGCTTACAGAAGCTGAA

ACAACTGCCAATGTCCTACAGGATGCTACCCGTAAGGAAAGGCTCCTAGA

AGACTCCAAGGGAGTAAAAGAGCTGATGAAACAATGGCAA

In some embodiments, an oligonucleotide useful for targeting DMD (e.g., for exon skipping) targets an exonic splicing enhancer (ESE) sequence in DMD (e.g., an ESE sequence of exon 23, 44, 45, 46, 50, 51, 52, 53, or 55). In some embodiments, an oligonucleotide useful for targeting DMD (e.g., for exon skipping) targets an exonic splicing enhancer (ESE) sequence in DMD (e.g., an ESE sequence of exon 8, 23, 43, 44, 45, 46, 50, 51, 52, 53, or 55). In some embodiments, an oligonucleotide useful for targeting DMD (e.g., for exon skipping) targets an ESE sequence of DMD exon 51 (e.g., the ESEs listed in Table 15). In some embodiments, an oligonucleotide useful for targeting DMD (e.g., for exon skipping) targets an ESE sequence of DMD exon 8, 23, 42, 44, 45, 46, 50, 52, 53, or 55 (e.g., an ESE listed in Table 11).

In some embodiments, an oligonucleotide useful for targeting DMD (e.g., for exon skipping, such as for skipping one or more of exons 8, 23, 42, 44, 45, 46, 50, 52, 53, and 55) comprises a region of complementarity to a target sequence comprising one or more full or partial ESEs of a DMD transcript (e.g., one or more full or partial ESEs listed in Table 15 or Table 11). In some embodiments, the oligonucleotide comprises a region of complementarity to a target sequence comprising one or more full or partial ESEs as set forth in SEQ ID NOs: 402-436 and 2043-2238. In some embodiments, the oligonucleotide comprises a region of complementarity to a target sequence comprising at least 4 (e.g., 4, 5, 6, 7, or 8) consecutive nucleotides of an ESE as set forth in any one of SEQ ID NOs: 402-436 and 2043-2238.

TABLE 15

Exonic splicing enhancers within exon 51 of DMD

| ESE # | Ref. start position* | SEQ ID NO: | ESE Motif Sequence | Name |
|---|---|---|---|---|
| 51-1 | 1565421 | 402 | CTACTCA | Dp427m_51:SRSF5 |
| 51-2 | 1565426 | 403 | CAGACTG | Dp427m_51:SRSF1 (IgM-BRCA1) |
| 51-3 | 1565428 | 404 | GACTGTTA | Dp427m_51:SRSF2 |
| 51-4 | 1565433 | 405 | TTACTCT | Dp427m_51:SRSF5 |
| 51-5 | 1565435 | 406 | ACTCTGG | Dp427m_51:SRSF5 |
| 51-6 | 1565436 | 407 | CTCTGGT | Dp427m_51:SRSF1 (IgM-BRCA1) |
| 51-7 | 1565442 | 408 | TGACACA | Dp427m_51:SRSF5 |
| 51-8 | 1565443 | 409 | GACACAA | Dp427m_51:SRSF1 |
| 51-9 | 1565444 | 410 | ACACAAC | Dp427m_51:SRSF5 |
| 51-10 | 1565448 | 411 | AACCTGTG | Dp427m_51:SRSF2 |
| 51-11 | 1565450 | 412 | CCTGTGG | Dp427m_51:SRSF5 |
| 51-12 | 1565451 | 413 | CTGTGGT | Dp427m_51:SRSF1 (IgM-BRCA1) |
| 51-13 | 1565455 | 414 | GGTTACTA | Dp427m_51:SRSF2 |
| 51-14 | 1565457 | 415 | TTACTAA | Dp427m_51:SRSF5 |
| 51-15 | 1565460 | 416 | CTAAGGA | Dp427m_51:SRSF1 (IgM-BRCA1) |
| 51-16 | 1565469 | 417 | CTGCCAT | Dp427m_51:SRSF1 (IgM-BRCA1) |
| 51-17 | 1565479 | 418 | CAAACTA | Dp427m_51:SRSF1 (IgM-BRCA1) |
| 51-18 | 1565508 | 419 | TGGAGGT | Dp427m_51:SRSF1 |
| 51-19 | 1565512 | 420 | GGTACCTG | Dp427m_51:SRSF2 |
| 51-20 | 1565528 | 421 | GATTTCAA | Dp427m_51:SRSF2 |
| 51-21 | 1565530 | 422 | TTTCAAC | Dp427m_51:SRSF5 |
| 51-22 | 1565532 | 423 | TCAACCG | Dp427m_51:SRSF5 |
| 51-23 | 1565533 | 424 | CAACCGG | Dp427m_51:SRSF1 (IgM-BRCA1) |
| 51-24 | 1565544 | 425 | GGACAGAA | Dp427m_51:SRSF2 |
| 51-25 | 1565556 | 426 | CCGACTG | Dp427m_51:SRSF1 (IgM-BRCA1) |
| 51-26 | 1565557 | 427 | CGACTGG | Dp427m_51:SRSF5 |
| 51-27 | 1565565 | 428 | TTTCTCTG | Dp427m_51:SRSF2 |
| 51-28 | 1565567 | 429 | TCTCTGC | Dp427m_51:SRSF5 |
| 51-29 | 1565591 | 430 | TCACAGA | Dp427m_51:SRSF5 |
| 51-30 | 1565592 | 431 | CACAGA | Dp427m_51:SRSF6 |
| 51-31 | 1565593 | 432 | ACAGAGG | Dp427m_51:SRSF5 |
| 51-32 | 1565594 | 433 | CAGAGGG | Dp427m_51:SRSF1 (IgM-BRCA1) |
| 51-33 | 1565615 | 434 | CTTGAGG | Dp427m_51:SRSF5 |
| 51-34 | 1565617 | 435 | TGAGGA | Dp427m_51:SRSF6 |
| 51-35 | 1565630 | 436 | GAGATGA | Dp427m_51:SRSF1 |

*Ref. start position refers to the position of the first nucleotide of the ESE motif in nucleotides 5,001-2,225,382 of NCBI Reference Sequence NG_012232.1 (NG_012232, version 1). Nucleotides 5,001-2,225,382 of NCBI Reference Sequence NG_012232.1 (NG_012232, version 1) correspond to Homo sapiens dystrophin (DMD) gene on chromosome X.

TABLE 11

Exonic splicing enhancers within exons 8, 23, 43, 44, 45, 46, 50, 52, 53, and 55 of DMD

| Exon | Ref. start position* | SEQ ID NO: | ESE Motif Sequence | Name |
|---|---|---|---|---|
| 8 | 640346 | 2047 | TCCATC | Dp427m_8:SRSF6 |
| 8 | 640358 | 2048 | TACATC | Dp427m_8:SRSF6 |
| 8 | 640362 | 2049 | TCACATC | Dp427m_8:SRSF5 |
| 8 | 640363 | 2050 | CACATC | Dp427m_8:SRSF6 |
| 8 | 640367 | 2051 | TCACTCT | Dp427m_8:SRSF5 |
| 8 | 640368 | 2052 | CACTCTT | Dp427m_8:SRSF1 (IgM-BRCA1) |
| 8 | 640373 | 2053 | TTCCAAG | Dp427m_8:SRSF5 |
| 8 | 640383 | 2054 | TGCCTC | Dp427m_8:SRSF6 |
| 8 | 640385 | 2055 | CCTCAAC | Dp427m_8:SRSF5 |

TABLE 11-continued

Exonic splicing enhancers within exons 8, 23, 43, 44, 45, 46, 50, 52, 53, and 55 of DMD

| Exon | Ref. start position* | SEQ ID NO: | ESE Motif Sequence | Name |
|---|---|---|---|---|
| 8 | 640388 | 2056 | CAACAAG | Dp427m_8:SRSF5 |
| 8 | 640434 | 2057 | GGCCACCT | Dp427m_8:SRSF2 |
| 8 | 640439 | 2058 | CCTAAAG | Dp427m_8:SRSF5 |
| 8 | 640447 | 2059 | GACTAAAG | Dp427m_8:SRSF2 |
| 8 | 640469 | 2060 | TTACATC | Dp427m_8:SRSF5 |
| 8 | 640470 | 2048 | TACATC | Dp427m_8:SRSF6 |
| 8 | 640477 | 2061 | TCAAATG | Dp427m_8:SRSF5 |
| 8 | 640490 | 2062 | TCTCAAC | Dp427m_8:SRSF5 |
| 23 | 870903 | 2063 | TTACAAA | Dp427m_23:SRSF5 |
| 23 | 870910 | 2064 | GTTCTCTG | Dp427m_23:SRSF2 |
| 23 | 870912 | 429 | TCTCTGC | Dp427m_23:SRSF5 |
| 23 | 870933 | 2065 | GGCCTATA | Dp427m_23:SRSF2 |
| 23 | 870944 | 2066 | TCTCAGC | Dp427m_23:SRSF5 |
| 23 | 870945 | 2067 | CTCAGCA | Dp427m_23:SRSF1 (IgM-BRCA1) |
| 23 | 870950 | 2068 | CACCACTG | Dp427m_23:SRSF2 |
| 23 | 870952 | 2069 | CCACTGT | Dp427m_23:SRSF5 |
| 23 | 870970 | 2070 | CGAAGAA | Dp427m_23:SRSF1 (IgM-BRCA1) |
| 23 | 870979 | 2071 | CGCCCTC | Dp427m_23:SRSF1 (IgM-BRCA1) |
| 23 | 870980 | 2072 | GCCCTCTG | Dp427m_23:SRSF2 |
| 23 | 870993 | 2073 | AGCCGGA | Dp427m_23:SRSF1 (IgM-BRCA1) |
| 23 | 871014 | 2074 | TTTGAAG | Dp427m_23:SRSF5 |
| 23 | 871028 | 2075 | GGGACGC | Dp427m_23:SRSF1 |
| 23 | 871029 | 2076 | GGACGCTG | Dp427m_23:SRSF2 |
| 23 | 871032 | 2077 | CGCTGGA | Dp427m_23:SRSF1 (IgM-BRCA1) |
| 23 | 871049 | 2078 | CTCCCAG | Dp427m_23:SRSF1 (IgM-BRCA1) |
| 23 | 871050 | 2079 | TCCCAGC | Dp427m_23:SRSF5 |
| 23 | 871051 | 2080 | CCCAGCT | Dp427m_23:SRSF1 (IgM-BRCA1) |
| 23 | 871053 | 2081 | CAGCTGG | Dp427m_23:SRSF1 (IgM-BRCA1) |
| 23 | 871070 | 2082 | TCAAAAG | Dp427m_23:SRSF5 |
| 23 | 871077 | 2083 | CTAGAGG | Dp427m_23:SRSF5 |
| 23 | 871078 | 2084 | TAGAGGA | Dp427m_23:SRSF1 |
| 23 | 871090 | 2085 | TGAATA | Dp427m_23:SRSF6 |
| 23 | 871098 | 2086 | CTCCGAA | Dp427m_23:SRSF1 (IgM-BRCA1) |
| 43 | 1051912 | 2087 | ATAAAAG | Dp427m_43:SRSF5 |
| 43 | 1051922 | 2088 | GTCTACAA | Dp427m_43:SRSF2 |
| 43 | 1051924 | 2089 | CTACAAC | Dp427m_43:SRSF5 |
| 43 | 1051929 | 2090 | ACAAAGC | Dp427m_43:SRSF5 |

TABLE 11-continued

Exonic splicing enhancers within exons 8, 23, 43, 44, 45, 46, 50, 52, 53, and 55 of DMD

| Exon | Ref. start position* | SEQ ID NO: | ESE Motif Sequence | Name |
|---|---|---|---|---|
| 43 | 1051934 | 2091 | GCTCAGG | Dp427m_43:SRSF5 |
| 43 | 1051935 | 2092 | CTCAGGT | Dp427m_43:SRSF1 (IgM-BRCA1) |
| 43 | 1051955 | 2093 | TTCATA | Dp427m_43:SRSF6 |
| 43 | 1051956 | 2094 | TCATAGC | Dp427m_43:SRSF5 |
| 43 | 1051967 | 2095 | AGACAGC | Dp427m_43:SRSF5 |
| 43 | 1051971 | 2096 | AGCAGC | Dp427m_43:SRSF6 |
| 43 | 1051986 | 2097 | TGCAAC | Dp427m_43:SRSF6 |
| 43 | 1051991 | 2098 | CGCCTGTG | Dp427m_43:SRSF2 |
| 43 | 1051993 | 412 | CCTGTGG | Dp427m_43:SRSF5 |
| 43 | 1051994 | 2099 | CTGTGGA | Dp427m_43:SRSF1 (IgM-BRCA1) |
| 43 | 1051995 | 2100 | TGTGGA | Dp427m_43:SRSF6 |
| 43 | 1052009 | 2101 | AGCTACAG | Dp427m_43:SRSF2 |
| 43 | 1052011 | 2102 | CTACAGG | Dp427m_43:SRSF5 |
| 43 | 1052012 | 2103 | TACAGGA | Dp427m_43:SRSF1 (IgM-BRCA1) |
| 43 | 1052022 | 2104 | TCTCTCC | Dp427m_43:SRSF5 |
| 43 | 1052023 | 2105 | CTCTCCCA | Dp427m_43:SRSF2 |
| 43 | 1052025 | 2078 | CTCCCAG | Dp427m_43:SRSF1 (IgM-BRCA1) |
| 43 | 1052026 | 2079 | TCCCAGC | Dp427m_43:SRSF5 |
| 43 | 1052027 | 2080 | CCCAGCT | Dp427m_43:SRSF1 (IgM-BRCA1) |
| 43 | 1052035 | 2106 | GATTTCCA | Dp427m_43:SRSF2 |
| 43 | 1052040 | 2107 | CCAATGG | Dp427m_43:SRSF5 |
| 43 | 1052064 | 2108 | GTACAAG | Dp427m_43:SRSF5 |
| 43 | 1052071 | 2109 | GACCGACA | Dp427m_43:SRSF2 |
| 43 | 1052073 | 2110 | CCGACAA | Dp427m_43:SRSF1 (IgM-BRCA1) |
| 43 | 1052074 | 2111 | CGACAAG | Dp427m_43:SRSF5 |
| 44 | 1122553 | 2112 | TGACAGA | Dp427m_44:SRSF5 |
| 44 | 1122575 | 2113 | CGGCGTT | Dp427m_44:SRSF1 (IgM-BRCA1) |
| 44 | 1122607 | 2114 | TCAGTGG | Dp427m_44:SRSF5 |
| 44 | 1122612 | 2115 | GGCTAACA | Dp427m_44:SRSF2 |
| 44 | 1122617 | 2116 | ACAGAAG | Dp427m_44:SRSF5 |
| 44 | 1122634 | 2117 | TCTCAGA | Dp427m_44:SRSF5 |
| 44 | 1122635 | 2118 | CTCAGAA | Dp427m_44:SRSF1 (IgM-BRCA1) |
| 44 | 1122643 | 409 | GACACAA | Dp427m_44:SRSF1 |
| 44 | 1122649 | 2119 | AATTCCTG | Dp427m_44:SRSF2 |
| 44 | 1122654 | 2120 | CTGAGAA | Dp427m_44:SRSF1 (IgM-BRCA1) |
| 44 | 1122685 | 2121 | GTATCTTA | Dp427m_44:SRSF2 |
| 45 | 1371096 | 2122 | GAACTCCA | Dp427m_45:SRSF2 |

TABLE 11-continued

Exonic splicing enhancers within exons 8, 23, 43, 44, 45, 46, 50, 52, 53, and 55 of DMD

| Exon | Ref. start position* | SEQ ID NO: | ESE Motif Sequence | Name |
|---|---|---|---|---|
| 45 | 1371097 | 2123 | AACTCCAG | Dp427m_45:SRSF2 |
| 45 | 1371099 | 2124 | CTCCAGG | Dp427m_45:SRSF5 |
| 45 | 1371117 | 2125 | CAGCGGC | Dp427m_45:SRSF1 (IgM-BRCA1) |
| 45 | 1371118 | 2126 | AGCGGC | Dp427m_45:SRSF6 |
| 45 | 1371133 | 2127 | TCAGAAC | Dp427m_45:SRSF5 |
| 45 | 1371136 | 2128 | GAACATTG | Dp427m_45:SRSF2 |
| 45 | 1371142 | 2129 | TGAATGC | Dp427m_45:SRSF5 |
| 45 | 1371143 | 2130 | GAATGCAA | Dp427m_45:SRSF2 |
| 45 | 1371146 | 2097 | TGCAAC | Dp427m_45:SRSF6 |
| 45 | 1371148 | 2131 | CAACTGG | Dp427m_45:SRSF5 |
| 45 | 1371151 | 2132 | CTGGGGA | Dp427m_45:SRSF1 (IgM-BRCA1) |
| 45 | 1371165 | 2133 | ATTCAGC | Dp427m_45:SRSF5 |
| 45 | 1371188 | 2134 | TGCCAGTA | Dp427m_45:SRSF2 |
| 45 | 1371193 | 2135 | GTATTCTA | Dp427m_45:SRSF2 |
| 45 | 1371198 | 2102 | CTACAGG | Dp427m_45:SRSF5 |
| 45 | 1371199 | 2103 | TACAGGA | Dp427m_45:SRSF1 (IgM-BRCA1) |
| 45 | 1371220 | 2136 | TGAATC | Dp427m_45:SRSF6 |
| 45 | 1371225 | 2137 | CTGCGGT | Dp427m_45:SRSF1 (IgM-BRCA1) |
| 45 | 1371226 | 2138 | TGCGGT | Dp427m_45:SRSF6 |
| 45 | 1371228 | 2139 | CGGTGGC | Dp427m_45:SRSF1 (IgM-BRCA1) |
| 45 | 1371231 | 2140 | TGGCAGG | Dp427m_45:SRSF5 |
| 45 | 1371232 | 2141 | GGCAGGA | Dp427m_45:SRSF1 (IgM-BRCA1) |
| 45 | 1371235 | 2142 | AGGAGGT | Dp427m_45:SRSF1 |
| 45 | 1371239 | 2143 | GGTCTGCA | Dp427m_45:SRSF2 |
| 45 | 1371240 | 2144 | GTCTGCAA | Dp427m_45:SRSF2 |
| 45 | 1371249 | 2145 | CAGCTGT | Dp427m_45:SRSF1 (IgM-BRCA1) |
| 45 | 1371256 | 2146 | CAGACAG | Dp427m_45:SRSF1 (IgM-BRCA1) |
| 46 | 1407384 | 2147 | CTAGAAG | Dp427m_46:SRSF5 |
| 46 | 1407392 | 2148 | ACAAAAG | Dp427m_46:SRSF5 |
| 46 | 1407438 | 2149 | GTTTTATG | Dp427m_46:SRSF2 |
| 46 | 1407440 | 2150 | TTTATGG | Dp427m_46:SRSF5 |
| 46 | 1407445 | 2151 | GGTTGGAG | Dp427m_46:SRSF2 |
| 46 | 1407448 | 2152 | TGGAGGA | Dp427m_46:SRSF1 (IgM-BRCA1) |
| 46 | 1407472 | 2153 | GTATCCCA | Dp427m_46:SRSF2 |
| 46 | 1407476 | 2154 | CCCACTT | Dp427m_46:SRSF1 (IgM-BRCA1) |
| 46 | 1407477 | 2155 | CCACTTG | Dp427m_46:SRSF5 |
| 46 | 1407478 | 2156 | CACTTGA | Dp427m_46:SRSF1 (IgM-BRCA1) |

TABLE 11-continued

Exonic splicing enhancers within exons 8, 23, 43, 44, 45, 46, 50, 52, 53, and 55 of DMD

| Exon | Ref. start position* | SEQ ID NO: | ESE Motif Sequence | Name |
|------|----------------------|------------|--------------------|------|
| 46 | 1407496 | 2096 | AGCAGC | Dp427m_46:SRSF6 |
| 46 | 1407504 | 2157 | CTAAAAG | Dp427m_46:SRSF5 |
| 46 | 1407524 | 2158 | AGTCAAG | Dp427m_46:SRSF5 |
| 50 | 1519533 | 2159 | TTAGAAG | Dp427m_50:SRSF5 |
| 50 | 1519539 | 2160 | GATCTGAG | Dp427m_50:SRSF2 |
| 50 | 1519541 | 2161 | TCTGAGC | Dp427m_50:SRSF5 |
| 50 | 1519542 | 2162 | CTGAGCT | Dp427m_50:SRSF1 (IgM-BRCA1) |
| 50 | 1519544 | 2163 | GAGCTCTG | Dp427m_50:SRSF2 |
| 50 | 1519549 | 2164 | CTGAGTG | Dp427m_50:SRSF1 (IgM-BRCA1) |
| 50 | 1519550 | 2165 | TGAGTGG | Dp427m_50:SRSF5 |
| 50 | 1519572 | 2166 | TTACTTC | Dp427m_50:SRSF5 |
| 50 | 1519573 | 2167 | TACTTC | Dp427m_50:SRSF6 |
| 50 | 1519575 | 2168 | CTTCAAG | Dp427m_50:SRSF5 |
| 50 | 1519584 | 2169 | CTGAGGG | Dp427m_50:SRSF1 (IgM-BRCA1) |
| 50 | 1519594 | 2096 | AGCAGC | Dp427m_50:SRSF6 |
| 50 | 1519596 | 2170 | CAGCCTG | Dp427m_50:SRSF1 (IgM-BRCA1) |
| 50 | 1519600 | 2171 | CTGACCT | Dp427m_50:SRSF1 (IgM-BRCA1) |
| 50 | 1519607 | 2172 | AGCTCCTG | Dp427m_50:SRSF2 |
| 50 | 1519609 | 2173 | CTCCTGG | Dp427m_50:SRSF5 |
| 50 | 1519617 | 2174 | CTGACCA | Dp427m_50:SRSF1 (IgM-BRCA1) |
| 50 | 1519619 | 2175 | GACCACTA | Dp427m_50:SRSF2 |
| 50 | 1519621 | 2176 | CCACTAT | Dp427m_50:SRSF5 |
| 50 | 1519624 | 2177 | CTATTGG | Dp427m_50:SRSF5 |
| 52 | 1609869 | 2178 | TGCAGG | Dp427m_52:SRSF6 |
| 52 | 1609880 | 2179 | GAACAGAG | Dp427m_52:SRSF2 |
| 52 | 1609882 | 432 | ACAGAGG | Dp427m_52:SRSF5 |
| 52 | 1609883 | 2180 | CAGAGGC | Dp427m_52:SRSF1 (IgM-BRCA1) |
| 52 | 1609887 | 2181 | GGCGTC | Dp427m_52:SRSF6 |
| 52 | 1609889 | 2182 | CGTCCCCA | Dp427m_52:SRSF2 |
| 52 | 1609890 | 2183 | GTCCCCAG | Dp427m_52:SRSF2 |
| 52 | 1609892 | 2184 | CCCCAGT | Dp427m_52:SRSF1 (IgM-BRCA1) |
| 52 | 1609893 | 2185 | CCCAGTT | Dp427m_52:SRSF1 (IgM-BRCA1) |
| 52 | 1609911 | 2186 | TTACCGC | Dp427m_52:SRSF5 |
| 52 | 1609912 | 2187 | TACCGCTG | Dp427m_52:SRSF2 |
| 52 | 1609917 | 2188 | CTGCCCA | Dp427m_52:SRSF1 (IgM-BRCA1) |
| 52 | 1609939 | 2189 | GACCAGCA | Dp427m_52:SRSF2 |
| 52 | 1609954 | 2190 | GGCTAGAA | Dp427m_52:SRSF2 |

TABLE 11-continued

Exonic splicing enhancers within exons 8, 23, 43, 44, 45, 46, 50, 52, 53, and 55 of DMD

| Exon | Ref. start position* | SEQ ID NO: | ESE Motif Sequence | Name |
|---|---|---|---|---|
| 52 | 1609969 | 2191 | TACGGA | Dp427m_52:SRSF6 |
| 52 | 1609972 | 2192 | GGATCGAA | Dp427m_52:SRSF2 |
| 53 | 1660030 | 2193 | GAATTCAG | Dp427m_53:SRSF2 |
| 53 | 1660040 | 2114 | TCAGTGG | Dp427m_53:SRSF5 |
| 53 | 1660041 | 2194 | CAGTGGG | Dp427m_53:SRSF1 (IgM-BRCA1) |
| 53 | 1660053 | 2108 | GTACAAG | Dp427m_53:SRSF5 |
| 53 | 1660067 | 2127 | TCAGAAC | Dp427m_53:SRSF5 |
| 53 | 1660071 | 2195 | AACCGGA | Dp427m_53:SRSF1 |
| 53 | 1660074 | 2196 | CGGAGGC | Dp427m_53:SRSF1 (IgM-BRCA1) |
| 53 | 1660098 | 2197 | TTAAAGG | Dp427m_53:SRSF5 |
| 53 | 1660103 | 2198 | GGATTCAA | Dp427m_53:SRSF2 |
| 53 | 1660112 | 2199 | ACAATGG | Dp427m_53:SRSF5 |
| 53 | 1660117 | 2200 | GGCTGGAA | Dp427m_53:SRSF2 |
| 53 | 1660126 | 416 | CTAAGGA | Dp427m_53:SRSF1 (IgM-BRCA1) |
| 53 | 1660138 | 2201 | CTGAGCA | Dp427m_53:SRSF1 (IgM-BRCA1) |
| 53 | 1660141 | 2202 | AGCAGGT | Dp427m_53:SRSF1 (IgM-BRCA1) |
| 53 | 1660147 | 2203 | TCTTAGG | Dp427m_53:SRSF5 |
| 53 | 1660148 | 2204 | CTTAGGA | Dp427m_53:SRSF1 (IgM-BRCA1) |
| 53 | 1660152 | 2205 | GGACAGG | Dp427m_53:SRSF5 |
| 53 | 1660153 | 2206 | GACAGGC | Dp427m_53:SRSF1 |
| 53 | 1660157 | 2207 | GGCCAGAG | Dp427m_53:SRSF2 |
| 53 | 1660159 | 2208 | CCAGAGC | Dp427m_53:SRSF5 |
| 53 | 1660172 | 2209 | TGAGTC | Dp427m_53:SRSF6 |
| 53 | 1660183 | 2210 | AGGAGGG | Dp427m_53:SRSF1 |
| 53 | 1660188 | 2211 | GGTCCCTA | Dp427m_53:SRSF2 |
| 53 | 1660197 | 2212 | ACAGTAG | Dp427m_53:SRSF5 |
| 53 | 1660211 | 2213 | CCAAAAG | Dp427m_53:SRSF5 |
| 53 | 1660222 | 430 | TCACAGA | Dp427m_53:SRSF5 |
| 53 | 1660223 | 431 | CACAGA | Dp427m_53:SRSF6 |
| 55 | 1711758 | 2214 | CGAGAGG | Dp427m_55:SRSF5 |
| 55 | 1711763 | 2215 | GGCTGCTT | Dp427m_55:SRSF2 |
| 55 | 1711786 | 2216 | GATTACTG | Dp427m_55:SRSF2 |
| 55 | 1711788 | 2217 | TTACTGC | Dp427m_55:SRSF5 |
| 55 | 1711792 | 2097 | TGCAAC | Dp427m_55:SRSF6 |
| 55 | 1711802 | 2218 | CCCCCTG | Dp427m_55:SRSF1 (IgM-BRCA1) |
| 55 | 1711803 | 2219 | CCCCTGG | Dp427m_55:SRSF5 |
| 55 | 1711804 | 2220 | CCCTGGA | Dp427m_55:SRSF1 (IgM-BRCA1) |

TABLE 11-continued

Exonic splicing enhancers within exons 8, 23, 43, 44, 45, 46, 50, 52, 53, and 55 of DMD

| Exon | Ref. start position* | SEQ ID NO: | ESE Motif Sequence | Name |
|---|---|---|---|---|
| 55 | 1711820 | 2221 | GTTTCTTG | Dp427m_55:SRSF2 |
| 55 | 1711821 | 2222 | TTTCTTG | Dp427m_55:SRSF5 |
| 55 | 1711826 | 2223 | TGCCTGG | Dp427m_55:SRSF5 |
| 55 | 1711831 | 2224 | GGCTTACA | Dp427m_55:SRSF2 |
| 55 | 1711834 | 2225 | TTACAGA | Dp427m_55:SRSF5 |
| 55 | 1711835 | 2226 | TACAGA | Dp427m_55:SRSF6 |
| 55 | 1711836 | 2116 | ACAGAAG | Dp427m_55:SRSF5 |
| 55 | 1711852 | 2227 | CTGCCAA | Dp427m_55:SRSF1 (IgM-BRCA1) |
| 55 | 1711853 | 2228 | TGCCAATG | Dp427m_55:SRSF2 |
| 55 | 1711860 | 2229 | GTCCTACA | Dp427m_55:SRSF2 |
| 55 | 1711863 | 2102 | CTACAGG | Dp427m_55:SRSF5 |
| 55 | 1711864 | 2103 | TACAGGA | Dp427m_55:SRSF1 (IgM-BRCA1) |
| 55 | 1711868 | 2230 | GGATGCTA | Dp427m_55:SRSF2 |
| 55 | 1711873 | 2231 | CTACCCG | Dp427m_55:SRSF5 |
| 55 | 1711874 | 2232 | TACCCGTA | Dp427m_55:SRSF2 |
| 55 | 1711888 | 2233 | GGCTCCTA | Dp427m_55:SRSF2 |
| 55 | 1711893 | 2147 | CTAGAAG | Dp427m_55:SRSF5 |
| 55 | 1711898 | 2234 | AGACTCC | Dp427m_55:SRSF5 |
| 55 | 1711899 | 2235 | GACTCCAA | Dp427m_55:SRSF2 |
| 55 | 1711901 | 2236 | CTCCAAG | Dp427m_55:SRSF5 |
| 55 | 1711903 | 2237 | CCAAGGG | Dp427m_55:SRSF1 (IgM-BRCA1) |
| 55 | 1711920 | 2238 | CTGATGA | Dp427m_55:SRSF1 (IgM-BRCA1) |
| 55 | 1711928 | 2199 | ACAATGG | Dp427m_55:SRSF5 |

*Ref. start position refers to the position of the first nucleotide of the ESE motif in nucleotides 5,001-2,225,382 of NCBI Reference Sequence NG_012232.1 (NG_012232, version 1). Nucleotides 5,001-2,225,382 of NCBI Reference Sequence NG_012232.1 (NG_012232, version 1) correspond to Homo sapiens dystrophin (DMD) gene on chromosome X.

In some embodiments, the oligonucleotide comprises a region of complementarity to a target sequence comprising one or more full or partial ESEs of DMD exon 8. In some embodiments, the oligonucleotide comprises a region of complementarity to a target sequence comprising at least 4 (e.g., 4, 5, 6, 7, or 8) consecutive nucleotides of an ESE of DMD exon 8. In some embodiments, the oligonucleotide comprises a region of complementarity to a target sequence comprising one or more full or partial ESEs as set forth in SEQ ID NOs: 2047-2062. In some embodiments, the oligonucleotide comprises a region of complementarity to a target sequence comprising at least 4 (e.g., 4, 5, 6, 7, or 8) consecutive nucleotides of an ESE as set forth in any one of SEQ ID NOs: 2047-2062. In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) of DMD exon 8. In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) as set forth in SEQ ID NOs: 2047-2062.

In some embodiments, an oligonucleotide useful for targeting DMD (e.g., for exon skipping) is 18-35 nucleotides in length, and comprises a region of complementarity to a target sequence comprising at least 4 (e.g., 4, 5, 6, 7, or 8) consecutive nucleotides of an ESE as set forth in any one of SEQ ID NOs: 2047-2062. In some embodiments, an oligonucleotide useful for targeting DMD (e.g., for exon skipping) is 20-30 (e.g., 20, 25, 30) nucleotides in length, and comprises a region of complementarity to a target sequence comprising at least 4 (e.g., 4, 5, 6, 7, or 8) consecutive nucleotides of an ESE as set forth in any one of SEQ ID NOS: 2047-2062. In some embodiments, an oligonucleotide useful for targeting DMD (e.g., for exon skipping) is 20 nucleotides in length, and comprises a region of complementarity to a target sequence comprising at least 4 (e.g., 4, 5, 6, 7, or 8) consecutive nucleotides of an ESE as set forth in any one of SEQ ID NOs: 2047-2062. In some embodiments, an oligonucleotide useful for targeting DMD (e.g., for exon skipping) is 30 nucleotides in length, and comprises a region of complementarity to a target sequence comprising at least 4 (e.g., 4, 5, 6, 7, or 8) consecutive nucleotides of an ESE as set forth in any one of SEQ ID NOs: 2047-2062.

In some embodiments, the oligonucleotide comprises a region of complementarity to a target sequence comprising one or more full or partial ESEs of DMD exon 23. In some embodiments, the oligonucleotide comprises a region of complementarity to a target sequence comprising at least 4 (e.g., 4, 5, 6, 7, or 8) consecutive nucleotides of an ESE of DMD exon 23. In some embodiments, the oligonucleotide comprises a region of complementarity to a target sequence comprising one or more full or partial ESEs as set forth in SEQ ID NOs: 429 and 2063-2086. In some embodiments, the oligonucleotide comprises a region of complementarity to a target sequence comprising at least 4 (e.g., 4, 5, 6, 7, or 8) consecutive nucleotides of an ESE as set forth in any one of SEQ ID NOs: 429 and 2063-2086.

In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) of DMD exon 23. In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) as set forth in SEQ ID NOs: 429 and 2063-2086.

In some embodiments, an oligonucleotide useful for targeting DMD (e.g., for exon skipping) is 18-35 nucleotides in length, and comprises a region of complementarity to a target sequence comprising at least 4 (e.g., 4, 5, 6, 7, or 8) consecutive nucleotides of an ESE as set forth in any one of SEQ ID NOs: 429 and 2063-2086. In some embodiments, an oligonucleotide useful for targeting DMD (e.g., for exon skipping) is 20-30 (e.g., 20, 25, 30) nucleotides in length, and comprises a region of complementarity to a target sequence comprising at least 4 (e.g., 4, 5, 6, 7, or 8) consecutive nucleotides of an ESE as set forth in any one of SEQ ID NOs: 429 and 2063-2086. In some embodiments, an oligonucleotide useful for targeting DMD (e.g., for exon skipping) is 20 nucleotides in length, and comprises a region of complementarity to a target sequence comprising at least 4 (e.g., 4, 5, 6, 7, or 8) consecutive nucleotides of an ESE as set forth in any one of SEQ ID NOs: 429 and 2063-2086. In some embodiments, an oligonucleotide useful for targeting DMD (e.g., for exon skipping) is 30 nucleotides in length, and comprises a region of complementarity to a target sequence comprising at least 4 (e.g., 4, 5, 6, 7, or 8) consecutive nucleotides of an ESE as set forth in any one of SEQ ID NOs: 429 and 2063-2086.

In some embodiments, the oligonucleotide comprises a region of complementarity to a target sequence comprising one or more full or partial ESEs of DMD exon 43. In some embodiments, the oligonucleotide comprises a region of complementarity to a target sequence comprising at least 4 (e.g., 4, 5, 6, 7, or 8) consecutive nucleotides of an ESE of DMD exon 43. In some embodiments, the oligonucleotide comprises a region of complementarity to a target sequence comprising one or more full or partial ESEs as set forth in SEQ ID NOs: 412, 2078-2080, and 2087-2111. In some embodiments, the oligonucleotide comprises a region of complementarity to a target sequence comprising at least 4 (e.g., 4, 5, 6, 7, or 8) consecutive nucleotides of an ESE as set forth in any one of SEQ ID NOs: 412, 2078-2080, and 2087-2111.

In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) of DMD exon 43. In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) as set forth in SEQ ID NOs: 412, 2078-2080, and 2087-2111.

In some embodiments, an oligonucleotide useful for targeting DMD (e.g., for exon skipping) is 18-35 nucleotides in length, and comprises a region of complementarity to a target sequence comprising at least 4 (e.g., 4, 5, 6, 7, or 8) consecutive nucleotides of an ESE as set forth in any one of SEQ ID NOs: 412, 2078-2080, and 2087-2111. In some embodiments, an oligonucleotide useful for targeting DMD (e.g., for exon skipping) is 20-30 (e.g., 20, 25, 30) nucleotides in length, and comprises a region of complementarity to a target sequence comprising at least 4 (e.g., 4, 5, 6, 7, or 8) consecutive nucleotides of an ESE as set forth in any one of SEQ ID NOs: 412, 2078-2080, and 2087-2111. In some embodiments, an oligonucleotide useful for targeting DMD (e.g., for exon skipping) is 20 nucleotides in length, and comprises a region of complementarity to a target sequence comprising at least 4 (e.g., 4, 5, 6, 7, or 8) consecutive nucleotides of an ESE as set forth in any one of SEQ ID NOs: 412, 2078-2080, and 2087-2111. In some embodiments, an oligonucleotide useful for targeting DMD (e.g., for exon skipping) is 30 nucleotides in length, and comprises a region of complementarity to a target sequence comprising at least 4 (e.g., 4, 5, 6, 7, or 8) consecutive nucleotides of an ESE as set forth in any one of SEQ ID NOs: 412, 2078-2080, and 2087-2111.

In some embodiments, the oligonucleotide comprises a region of complementarity to a target sequence comprising one or more full or partial ESEs of DMD exon 44. In some embodiments, the oligonucleotide comprises a region of complementarity to a target sequence comprising at least 4 (e.g., 4, 5, 6, 7, or 8) consecutive nucleotides of an ESE of DMD exon 44. In some embodiments, the oligonucleotide comprises a region of complementarity to a target sequence comprising one or more full or partial ESEs as set forth in SEQ ID NOs: 409 and 2112-2121. In some embodiments, the oligonucleotide comprises a region of complementarity to a target sequence comprising at least 4 (e.g., 4, 5, 6, 7, or 8) consecutive nucleotides of an ESE as set forth in any one of SEQ ID NOs: 409 and 2112-2121.

In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) of DMD exon 44. In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) as set forth in SEQ ID NOs: 409 and 2112-2121.

In some embodiments, an oligonucleotide useful for targeting DMD (e.g., for exon skipping) is 18-35 nucleotides in length, and comprises a region of complementarity to a target sequence comprising at least 4 (e.g., 4, 5, 6, 7, or 8) consecutive nucleotides of an ESE as set forth in any one of SEQ ID NOs: 409 and 2112-2121. In some embodiments, an oligonucleotide useful for targeting DMD (e.g., for exon skipping) is 20-30 (e.g., 20, 25, 30) nucleotides in length, and comprises a region of complementarity to a target sequence comprising at least 4 (e.g., 4, 5, 6, 7, or 8) consecutive nucleotides of an ESE as set forth in any one of SEQ ID NOs: 409 and 2112-2121. In some embodiments, an oligonucleotide useful for targeting DMD (e.g., for exon skipping) is 20 nucleotides in length, and comprises a region of complementarity to a target sequence comprising at least 4 (e.g., 4, 5, 6, 7, or 8) consecutive nucleotides of an ESE as set forth in any one of SEQ ID NOs: 409 and 2112-2121. In some embodiments, an oligonucleotide useful for targeting DMD (e.g., for exon skipping) is 30 nucleotides in length, and comprises a region of complementarity to a target sequence comprising at least 4 (e.g., 4, 5, 6, 7, or 8) consecutive nucleotides of an ESE as set forth in any one of SEQ ID NOs: 409 and 2112-2121.

In some embodiments, the oligonucleotide comprises a region of complementarity to a target sequence comprising one or more full or partial ESEs of DMD exon 45. In some embodiments, the oligonucleotide comprises a region of complementarity to a target sequence comprising at least 4 (e.g., 4, 5, 6, 7, or 8) consecutive nucleotides of an ESE of DMD exon 45. In some embodiments, the oligonucleotide comprises a region of complementarity to a target sequence comprising one or more full or partial ESEs as set forth in SEQ ID NOs: 2097, 2102, 2103, and 2122-2146. In some embodiments, the oligonucleotide comprises a region of complementarity to a target sequence comprising at least 4 (e.g., 4, 5, 6, 7, or 8) consecutive nucleotides of an ESE as set forth in any one of SEQ ID NOs: 2097, 2102, 2103, and 2122-2146.

In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) of DMD exon 45. In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) as set forth in SEQ ID NOs: 2097, 2102, 2103, and 2122-2146.

In some embodiments, an oligonucleotide useful for targeting DMD (e.g., for exon skipping) is 18-35 nucleotides in length, and comprises a region of complementarity to a target sequence comprising at least 4 (e.g., 4, 5, 6, 7, or 8) consecutive nucleotides of an ESE as set forth in any one of SEQ ID NOs: 2097, 2102, 2103, and 2122-2146. In some embodiments, an oligonucleotide useful for targeting DMD (e.g., for exon skipping) is 20-30 (e.g., 20, 25, 30) nucleotides in length, and comprises a region of complementarity to a target sequence comprising at least 4 (e.g., 4, 5, 6, 7, or 8) consecutive nucleotides of an ESE as set forth in any one of SEQ ID NOs: 2097, 2102, 2103, and 2122-2146. In some embodiments, an oligonucleotide useful for targeting DMD (e.g., for exon skipping) is 20 nucleotides in length, and comprises a region of complementarity to a target sequence comprising at least 4 (e.g., 4, 5, 6, 7, or 8) consecutive nucleotides of an ESE as set forth in any one of SEQ ID NOs: 2097, 2102, 2103, and 2122-2146. In some embodiments, an oligonucleotide useful for targeting DMD (e.g., for exon skipping) is 30 nucleotides in length, and comprises a region of complementarity to a target sequence comprising at least 4 (e.g., 4, 5, 6, 7, or 8) consecutive nucleotides of an ESE as set forth in any one of SEQ ID NOs: 2097, 2102, 2103, and 2122-2146.

In some embodiments, the oligonucleotide comprises a region of complementarity to a target sequence comprising one or more full or partial ESEs of DMD exon 46. In some embodiments, the oligonucleotide comprises a region of complementarity to a target sequence comprising at least 4 (e.g., 4, 5, 6, 7, or 8) consecutive nucleotides of an ESE of DMD exon 46. In some embodiments, the oligonucleotide comprises a region of complementarity to a target sequence comprising one or more full or partial ESEs as set forth in SEQ ID NOs: 2096 and 2147-2158. In some embodiments, the oligonucleotide comprises a region of complementarity to a target sequence comprising at least 4 (e.g., 4, 5, 6, 7, or 8) consecutive nucleotides of an ESE as set forth in any one of SEQ ID NOs: 2096 and 2147-2158.

In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) of DMD exon 46. In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) as set forth in SEQ ID NOs: 2096 and 2147-2158.

In some embodiments, an oligonucleotide useful for targeting DMD (e.g., for exon skipping) is 18-35 nucleotides in length, and comprises a region of complementarity to a target sequence comprising at least 4 (e.g., 4, 5, 6, 7, or 8) consecutive nucleotides of an ESE as set forth in any one of SEQ ID NOs: 2096 and 2147-2158. In some embodiments, an oligonucleotide useful for targeting DMD (e.g., for exon skipping) is 20-30 (e.g., 20, 25, 30) nucleotides in length, and comprises a region of complementarity to a target sequence comprising at least 4 (e.g., 4, 5, 6, 7, or 8) consecutive nucleotides of an ESE as set forth in any one of SEQ ID NOs: 2096 and 2147-2158. In some embodiments, an oligonucleotide useful for targeting DMD (e.g., for exon skipping) is 20 nucleotides in length, and comprises a region of complementarity to a target sequence comprising at least 4 (e.g., 4, 5, 6, 7, or 8) consecutive nucleotides of an ESE as set forth in any one of SEQ ID NOs: 2096 and 2147-2158. In some embodiments, an oligonucleotide useful for targeting DMD (e.g., for exon skipping) is 30 nucleotides in length, and comprises a region of complementarity to a target sequence comprising at least 4 (e.g., 4, 5, 6, 7, or 8) consecutive nucleotides of an ESE as set forth in any one of SEQ ID NOs: 2096 and 2147-2158.

In some embodiments, the oligonucleotide comprises a region of complementarity to a target sequence comprising one or more full or partial ESEs of DMD exon 50. In some embodiments, the oligonucleotide comprises a region of complementarity to a target sequence comprising at least 4 (e.g., 4, 5, 6, 7, or 8) consecutive nucleotides of an ESE of DMD exon 50. In some embodiments, the oligonucleotide comprises a region of complementarity to a target sequence comprising one or more full or partial ESEs as set forth in SEQ ID NOs: 2096 and 2160-2177. In some embodiments, the oligonucleotide comprises a region of complementarity to a target sequence comprising at least 4 (e.g., 4, 5, 6, 7, or 8) consecutive nucleotides of an ESE as set forth in any one of SEQ ID NOs: 2096 and 2160-2177.

In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) of DMD exon 50. In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) as set forth in SEQ ID NOs: 2096 and 2160-2177.

In some embodiments, an oligonucleotide useful for targeting DMD (e.g., for exon skipping) is 18-35 nucleotides in length, and comprises a region of complementarity to a target sequence comprising at least 4 (e.g., 4, 5, 6, 7, or 8) consecutive nucleotides of an ESE as set forth in any one of SEQ ID NOs: 2096 and 2160-2177. In some embodiments, an oligonucleotide useful for targeting DMD (e.g., for exon skipping) is 20-30 (e.g., 20, 25, 30) nucleotides in length, and comprises a region of complementarity to a target sequence comprising at least 4 (e.g., 4, 5, 6, 7, or 8) consecutive nucleotides of an ESE as set forth in any one of SEQ ID NOs: 2096 and 2160-2177. In some embodiments, an oligonucleotide useful for targeting DMD (e.g., for exon skipping) is 20 nucleotides in length, and comprises a region of complementarity to a target sequence comprising at least 4 (e.g., 4, 5, 6, 7, or 8) consecutive nucleotides of an ESE as set forth in any one of SEQ ID NOs: 2096 and 2160-2177. In some embodiments, an oligonucleotide useful for targeting DMD (e.g., for exon skipping) is 30 nucleotides in length, and comprises a region of complementarity to a target sequence comprising at least 4 (e.g., 4, 5, 6, 7, or 8) consecutive nucleotides of an ESE as set forth in any one of SEQ ID NOs: 2096 and 2160-2177.

In some embodiments, the oligonucleotide comprises a region of complementarity to a target sequence comprising one or more full or partial ESEs of DMD exon 51. In some embodiments, the oligonucleotide comprises a region of complementarity to a target sequence comprising at least 4 (e.g., 4, 5, 6, 7, or 8) consecutive nucleotides of an ESE of DMD exon 51. In some embodiments, the oligonucleotide comprises a region of complementarity to a target sequence comprising one or more full or partial ESEs as set forth in SEQ ID NOs: 402-436. In some embodiments, the oligonucleotide comprises a region of complementarity to a target sequence comprising at least 4 (e.g., 4, 5, 6, 7, or 8) consecutive nucleotides of an ESE as set forth in any one of SEQ ID NOs: 402-436. In some embodiments, the oligonucleotide comprises a region of complementarity to a target sequence comprising at least 4 (e.g., 4, 5, 6, 7, 8) consecutive nucleotides of an ESE as set forth in SEQ ID NO: 419.

In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) of DMD exon 51. In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) as set forth in SEQ ID NOs: 402-436. In some embodiments, the oligonucleotide comprises a region of complementarity to a target sequence comprising at least 6 (e.g., 6, 7, 8, 9, 10, 11, 12, 13, or 14) nucleotides of ESEs as set forth in SEQ ID NO: 418 and SEQ ID NO: 419.

In some embodiments, an oligonucleotide useful for targeting DMD (e.g., for exon skipping) is 18-35 nucleotides in length, and comprises a region of complementarity to a target sequence comprising at least 4 (e.g., 4, 5, 6, 7, or 8) consecutive nucleotides of an ESE as set forth in any one of SEQ ID NOs: 402-436. In some embodiments, an oligonucleotide useful for targeting DMD (e.g., for exon skipping) is 20-30 (e.g., 20, 25, 30) nucleotides in length, and comprises a region of complementarity to a target sequence comprising at least 4 (e.g., 4, 5, 6, 7, or 8) consecutive nucleotides of an ESE as set forth in any one of SEQ ID NOs: 402-436. In some embodiments, an oligonucleotide useful for targeting DMD (e.g., for exon skipping) is 20 nucleotides in length, and comprises a region of complementarity to a target sequence comprising at least 4 (e.g., 4, 5, 6, 7, or 8) consecutive nucleotides of an ESE as set forth in any one of SEQ ID NOs: 402-436. In some embodiments, an oligonucleotide useful for targeting DMD (e.g., for exon skipping) is 30 nucleotides in length, and comprises a region of complementarity to a target sequence comprising at least 4 (e.g., 4, 5, 6, 7, or 8) consecutive nucleotides of an ESE as set forth in any one of SEQ ID NOs: 402-436.

In some embodiments, an oligonucleotide useful for targeting DMD (e.g., for exon skipping) is 20-30 (e.g., 20, 25, 30) nucleotides in length and comprises a region of complementarity to a target sequence comprising at least 4 (e.g., 4, 5, 6, 7, or 8) consecutive nucleotides of an ESE as set forth in SEQ ID NO: 419. In some embodiments, an oligonucleotide useful for targeting DMD (e.g., for exon skipping) is 30 nucleotides in length and comprises a region of complementarity to a target sequence comprising at least 4 (e.g., 4, 5, 6, 7, or 8) consecutive nucleotides of an ESE as set forth in SEQ ID NO: 419.

In some embodiments, the oligonucleotide is 20-30 (e.g., 20, 25, 30) nucleotides in length and comprises a region of complementarity to a target sequence comprising at least 6 (e.g., 6, 7, 8, 9, 10, 11, 12, 13, or 14) nucleotides of ESEs as set forth in SEQ ID NO: 418 and SEQ ID NO: 419. In some embodiments, the oligonucleotide is 30 nucleotides in length and comprises a region of complementarity to a target sequence comprising at least 6 (e.g., 6, 7, 8, 9, 10, 11, 12, 13, or 14) nucleotides of ESEs as set forth in SEQ ID NO: 418 and SEQ ID NO: 419.

Non-limiting examples of oligonucleotides that are useful for DMD exon 51 skipping and their target sequences are provided in SEQ ID NOs: 437-1241 and SEQ ID NOS: 1242-2046, respectively. In some embodiments, the oligonucleotide is 20-30 nucleotides in length and comprises a region of complementarity to a target sequence comprising at least 20 consecutive nucleotides of any one of SEQ ID NOs: 1242-2046. In some embodiments, the oligonucleotide is 20-30 nucleotides in length and comprises at least 20 consecutive nucleotides of any one of SEQ ID NOs: 437-1241. In some embodiments, the oligonucleotide comprises the nucleotide sequence of any one of SEQ ID NOs: 437-1241. In some embodiments, the oligonucleotide is at least 30 nucleotides (e.g., 30, 31, 32, 33, 34, or 35) in length and comprises the nucleotide sequence of any one of SEQ ID NOs: 437-1241.

In some embodiments, the oligonucleotide is 20-30 nucleotides in length and comprises a region of complementarity to a target sequence comprising at least 20 consecutive nucleotides of any one of SEQ ID NOs: 1548, 1550, 1551, 1552, 1555, 1558, 1559, 1562, 1565, 1569, 1577, 1583, 1589, 1595, 1600, 1606, 1610, 1614, 1621, 1626, 1629, 1632, 1637, 1640, 1643, 1646, 1650, 1655, 1658, and 1662. In some embodiments, the oligonucleotide is 20-30 nucleotides in length and comprises at least 20 consecutive nucleotides of any one of SEQ ID NO: 743, 745, 746, 747, 750, 753, 754, 757, 760, 764, 772, 778, 784, 790, 795, 801, 805, 809, 816, 821, 824, 827, 832, 835, 838, 841, 845, 850, 853, and 857. In some embodiments, the oligonucleotide comprises the nucleotide sequence of any one of SEQ ID NOs: 743, 745, 746, 747, 750, 753, 754, 757, 760, 764, 772, 778, 784, 790, 795, 801, 805, 809, 816, 821, 824, 827, 832, 835, 838, 841, 845, 850, 853, and 857. In some embodiments, the oligonucleotide is 30 nucleotides in length and comprises the nucleotide sequence of any one of SEQ ID NOs: 743, 745, 746, 747, 750, 753, 754, 757, 760, 764, 772, 778, 784, 790, 795, 801, 805, 809, 816, 821, 824, 827, 832, 835, 838, 841, 845, 850, 853, and 857.

In some embodiments, the oligonucleotide comprises a region of complementarity to a target sequence comprising one or more full or partial ESEs of DMD exon 52. In some embodiments, the oligonucleotide comprises a region of complementarity to a target sequence comprising at least 4 (e.g., 4, 5, 6, 7, or 8) consecutive nucleotides of an ESE of DMD exon 52. In some embodiments, the oligonucleotide comprises a region of complementarity to a target sequence comprising one or more full or partial ESEs as set forth in SEQ ID NOs: 432 and 2178-2192. In some embodiments, the oligonucleotide comprises a region of complementarity to a target sequence comprising at least 4 (e.g., 4, 5, 6, 7, or 8) consecutive nucleotides of an ESE as set forth in any one of SEQ ID NOs: 432 and 2178-2192.

In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) of DMD exon 52. In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) as set forth in SEQ ID NOs: 432 and 2178-2192.

In some embodiments, an oligonucleotide useful for targeting DMD (e.g., for exon skipping) is 18-35 nucleotides in length, and comprises a region of complementarity to a target sequence comprising at least 4 (e.g., 4, 5, 6, 7, or 8) consecutive nucleotides of an ESE as set forth in any one of SEQ ID NOs: 432 and 2178-2192. In some embodiments, an oligonucleotide useful for targeting DMD (e.g., for exon skipping) is 20-30 (e.g., 20, 25, 30) nucleotides in length, and comprises a region of complementarity to a target sequence comprising at least 4 (e.g., 4, 5, 6, 7, or 8) consecutive nucleotides of an ESE as set forth in any one of SEQ ID NOs: 432 and 2178-2192. In some embodiments, an oligonucleotide useful for targeting DMD (e.g., for exon skipping) is 20 nucleotides in length, and comprises a region of complementarity to a target sequence comprising at least 4 (e.g., 4, 5, 6, 7, or 8) consecutive nucleotides of an ESE as set forth in any one of SEQ ID NOs: 432 and 2178-2192. In some embodiments, an oligonucleotide useful for targeting DMD (e.g., for exon skipping) is 30 nucleotides in length, and comprises a region of complementarity to a target sequence comprising at least 4 (e.g., 4, 5, 6, 7, or 8) consecutive nucleotides of an ESE as set forth in any one of SEQ ID NOs: 432 and 2178-2192.

In some embodiments, the oligonucleotide comprises a region of complementarity to a target sequence comprising one or more full or partial ESEs of DMD exon 53. In some embodiments, the oligonucleotide comprises a region of complementarity to a target sequence comprising at least 4 (e.g., 4, 5, 6, 7, or 8) consecutive nucleotides of an ESE of DMD exon 53. In some embodiments, the oligonucleotide comprises a region of complementarity to a target sequence comprising one or more full or partial ESEs as set forth in SEQ ID NOs: 416, 430, 431, 2108, 2114, 2127, and 2193-2213. In some embodiments, the oligonucleotide comprises a region of complementarity to a target sequence comprising at least 4 (e.g., 4, 5, 6, 7, or 8) consecutive nucleotides of an ESE as set forth in any one of SEQ ID NOs: 416, 430, 431, 2108, 2114, 2127, and 2193-2213.

In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) of DMD exon 53. In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) as set forth in SEQ ID NOs: 416, 430, 431, 2108, 2114, 2127, and 2193-2213.

In some embodiments, an oligonucleotide useful for targeting DMD (e.g., for exon skipping) is 18-35 nucleotides in length, and comprises a region of complementarity to a target sequence comprising at least 4 (e.g., 4, 5, 6, 7, or 8) consecutive nucleotides of an ESE as set forth in any one of SEQ ID NOs: 416, 430, 431, 2108, 2114, 2127, and 2193-2213. In some embodiments, an oligonucleotide useful for targeting DMD (e.g., for exon skipping) is 20-30 (e.g., 20, 25, 30) nucleotides in length, and comprises a region of complementarity to a target sequence comprising at least 4 (e.g., 4, 5, 6, 7, or 8) consecutive nucleotides of an ESE as set forth in any one of SEQ ID NOs: 416, 430, 431, 2108, 2114, 2127, and 2193-2213. In some embodiments, an oligonucleotide useful for targeting DMD (e.g., for exon skipping) is 20 nucleotides in length, and comprises a region of complementarity to a target sequence comprising at least 4 (e.g., 4, 5, 6, 7, or 8) consecutive nucleotides of an ESE as set forth in any one of SEQ ID NOs: 416, 430, 431, 2108, 2114, 2127, and 2193-2213. In some embodiments, an oligonucleotide useful for targeting DMD (e.g., for exon skipping) is 30 nucleotides in length, and comprises a region of complementarity to a target sequence comprising at least 4 (e.g., 4, 5, 6, 7, or 8) consecutive nucleotides of an ESE as set forth in any one of SEQ ID NOS: 416, 430, 431, 2108, 2114, 2127, and 2193-2213.

In some embodiments, the oligonucleotide comprises a region of complementarity to a target sequence comprising one or more full or partial ESEs of DMD exon 55. In some embodiments, the oligonucleotide comprises a region of complementarity to a target sequence comprising at least 4 (e.g., 4, 5, 6, 7, or 8) consecutive nucleotides of an ESE of DMD exon 55. In some embodiments, the oligonucleotide comprises a region of complementarity to a target sequence comprising one or more full or partial ESEs as set forth in SEQ ID NOs: 2097, 2102, 2103, 2116, 2147, 2199, and 2214-2238. In some embodiments, the oligonucleotide comprises a region of complementarity to a target sequence comprising at least 4 (e.g., 4, 5, 6, 7, or 8) consecutive nucleotides of an ESE as set forth in any one of SEQ ID NOs: 2097, 2102, 2103, 2116, 2147, 2199, and 2214-2238.

In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) of DMD exon 55. In some embodiments, the oligonucleotide comprises a region of complementarity to a target sequence comprising at least 6 (e.g., 6, 7, 8, 9, 10, 11, 12, 13, 14, 15, 16, 17, 18, 19, 20, or more) nucleotides of one or more ESEs (e.g., 2, 3, 4, or more adjacent ESEs) as set forth in SEQ ID NOs: 2097, 2102, 2103, 2116, 2147, 2199, and 2214-2238.

In some embodiments, an oligonucleotide useful for targeting DMD (e.g., for exon skipping) is 18-35 nucleotides in length, and comprises a region of complementarity to a target sequence comprising at least 4 (e.g., 4, 5, 6, 7, or 8) consecutive nucleotides of an ESE as set forth in any one of SEQ ID NOs: 2097, 2102, 2103, 2116, 2147, 2199, and 2214-2238. In some embodiments, an oligonucleotide useful for targeting DMD (e.g., for exon skipping) is 20-30 (e.g., 20, 25, 30) nucleotides in length, and comprises a region of complementarity to a target sequence comprising at least 4 (e.g., 4, 5, 6, 7, or 8) consecutive nucleotides of an ESE as set forth in any one of SEQ ID NOs: 2097, 2102, 2103, 2116, 2147, 2199, and 2214-2238. In some embodiments, an oligonucleotide useful for targeting DMD (e.g., for exon skipping) is 20 nucleotides in length, and comprises a region of complementarity to a target sequence comprising at least 4 (e.g., 4, 5, 6, 7, or 8) consecutive nucleotides of an ESE as set forth in any one of SEQ ID NOs: 2097, 2102, 2103, 2116, 2147, 2199, and 2214-2238. In some embodiments, an oligonucleotide useful for targeting DMD (e.g., for exon skipping) is 30 nucleotides in length, and comprises a region of complementarity to a target sequence comprising at least 4 (e.g., 4, 5, 6, 7, or 8) consecutive nucleotides of an ESE as set forth in any one of SEQ ID NOs: 2097, 2102, 2103, 2116, 2147, 2199, and 2214-2238.

In some embodiments, any one of the oligonucleotides useful for targeting DMD (e.g., for exon skipping) is a phosphorodiamidate morpholino oligomer (PMO).

Additional examples of oligonucleotides targeting DMD (e.g., for exon skipping) are provided in U.S. Patent Application Publication 2013-072541, published Mar. 21, 2013, entitled "ADENO-ASSOCIATED VIRAL VECTOR FOR EXON SKIPPING IN A GENE ENCODING A DISPENSIBLE-DOMAIN PROTEIN"; U.S. Patent Application Publication 2015-191725, published Jul. 9, 2015, entitled "OLIGONUCLEOTIDE FOR THE TREATMENT OF MUSCULAR DYSTROPHY PATIENTS"; U.S. Patent Application Publication 2015-196670, published Jul. 16, 2015, entitled "COMPOSITIONS AND METHODS FOR DUCHENNE MUSCULAR DYSTROPHY GENE THERAPY"; U.S. Patent Application Publication 2017-349905, published Dec. 7, 2017, entitled "GENOME EDITING WITH SPLIT CAS9 EXPRESSED FROM TWO VECTORS"; U.S. Patent Application Publication 2018-028554, published Feb. 1, 2018, entitled "OLIGOMERS HAVING BICYCLIC SCAFFOLD MOEITIES"; U.S. Patent Application Publication 2018-171333, published Jun. 21, 2018, entitled "ANTISENSE MOLECULES AND METHODS FOR TREATING PATHOLOGIES"; U.S. Patent Application Publication 2018-179538, published Jun. 28, 2018, entitled "ANTISENSE NUCLEIC ACIDS"; U.S. Patent Application Publication 2018-265859, published Sep. 20, 2018, entitled "MODIFICATION OF THE DYSTROPHIN GENE AND USES THEREOF"; U.S. Patent Application Publication 2018-369400, published Dec. 27, 2018, entitled "NUCLEIC ACID-POLYPEPTIDE COMPOSITIONS AND METHODS OF INDUCING EXON SKIPPING"; U.S. Patent Application Publication 2019-000986, published Jan. 3, 2019, entitled "NUCLEIC ACID-POLYPEPTIDE COMPOSITIONS AND METHODS OF INDUCING EXON SKIPPING"; U.S. Patent Application Publication 2019-008986, published Jan. 10, 2019, entitled "OLIGONUCLEOTIDE COMPOSITIONS AND METHODS THEREOF"; U.S. Patent Application Publication 2019-112604, published Apr. 18, 2019, entitled "METHODS AND MEANS FOR EFFICIENT SKIPPING OF EXON 45 IN DUCHENNE MUSCULAR DYSTROPHY PRE-MRNA"; U.S. Patent Application Publication 2019-119679, published Apr. 25, 2019, entitled "METHODS AND MEANS FOR EFFICIENT SKIPPING OF EXON 45 IN DUCHENNE MUSCULAR DYSTROPHY PRE-MRNA"; U.S. Patent Application Publication 2019-127733, published May 2, 2019, entitled "OLIGONUCLEOTIDE COMPOSITIONS AND METHODS THEREOF"; U.S. Patent Application Publication 2019-151476, published May 23, 2019, entitled "THERAPEUTIC APPLICATIONS OF CPF1-BASED GENOME EDITING"; U.S. Patent Application Publication 2019-177723, published Jun. 13, 2019, entitled "COMPOSITIONS AND METHODS FOR TREATING DUCHENNE MUSCULAR DYSTROPHY AND RELATED DISORDERS"; U.S. Patent Application Publication 2019-177725, published Jun. 13, 2019, entitled "METHODS AND MEANS FOR EFFICIENT SKIPPING OF EXON 45 IN DUCHENNE MUSCULAR DYSTROPHY PRE-MRNA"; U.S. Patent Application Publication 2019-209604, published Jul. 11, 2019, entitled "OLIGONUCLEOTIDES, COMPOSITIONS AND METHODS THEREOF"; U.S. Patent Application Publication 2019-249173, published Aug. 15, 2019, entitled "METHODS AND COMPOSITIONS OF BIOLOGICALLY ACTIVE AGENTS"; U.S. Patent Application Publication 2019-270994, published Sep. 5, 2019, entitled "ANTISENSE MOLECULES AND METHODS FOR TREATING PATHOLOGIES"; U.S. Patent Application Publication 2019-284556, published Sep. 19, 2019, entitled "MULTIPLE EXON SKIPPING COMPOSITIONS FOR DMD"; U.S. Patent Application Publication 2019-323010, published Oct. 24, 2019, entitled "ANTISENSE OLIGONUCLEOTIDES FOR INDUCING EXON SKIPPING AND METHODS OF USE THEREOF"; U.S. Patent Application Publication 2019-330626, published Oct. 31, 2019, entitled "COMPOUNDS AND METHODS FOR USE IN DYSTROPHIN TRANSCRIPT"; U.S. Patent Application Publication 2019-338311, published Nov. 7, 2019, entitled "OPTIMIZED STRATEGY FOR EXON SKIPPING MODIFICATIONS USING CRISPR/CAS9 WITH TRIPLE GUIDE SEQUENCES"; U.S. Patent Application Publication 2019-359982, published Nov. 28, 2019, entitled "COMPOSITIONS FOR TREATING MUSCULAR DYSTROPHY"; U.S. Patent Application Publication 2019-364862, published Dec. 5, 2019, entitled "DMD REPORTER MODELS CONTAINING HUMANIZED DUCHENNE MUSCULAR DYSTROPHY MUTATIONS"; U.S. Patent Application Publication 2019-390197, published Dec. 26, 2019, entitled "OLIGONUCLEOTIDE COMPOSITIONS AND METHODS THEREOF"; U.S. Patent Application Publication 2020-040337, published Feb. 6, 2020, entitled "COMPOSITIONS FOR TREATING MUSCULAR DYSTROPHY"; U.S. Pat. No. 10,287,586, issued May 14, 2019, entitled "ANTISENSE MOLECULES AND METHODS FOR TREATING PATHOLOGIES"; U.S. Pat. No. 10,337,003, issued Jul. 2, 2019, entitled "COMPOSITIONS FOR TREATING MUSCULAR DYSTROPHY"; U.S. Pat. No. 10,364,431, issued Jul. 30, 2019, entitled "COMPOSITIONS FOR TREATING MUSCULAR DYSTROPHY"; U.S. Pat. No. 10,450,568, issued Oct. 22, 2019, entitled "OLIGONUCLEOTIDE COMPOSITIONS AND METHODS THEREOF"; U.S. Pat. No. 10,487,106, issued Nov. 26, 2019, entitled "ANTISENSE NUCLEIC ACIDS"; U.S. Pat.

No. 10,533,171, issued Jan. 14, 2020, entitled "OLIGONUCLEOTIDE COMPRISING AN INOSINE FOR TREATING DMD"; U.S. Pat. No. 10,704,060, issued Jul. 7, 2020, entitled "RNA-GUIDED GENE EDITING AND GENE REGULATION"; U.S. Pat. No. 10,752,898, issued Aug. 25, 2020, entitled "EFFECTIVE GENE THERAPY TOOLS FOR DYSTROPHIN EXON 53 SKIPPING"; U.S. Pat. No. 10,876,114, issued Dec. 29, 2020, entitled "METHODS AND MEANS FOR EFFICIENT SKIPPING OF AT LEAST ONE OF THE FOLLOWING EXONS OF THE HUMAN DUCHENNE MUSCULAR DYSTROPHY GENE: 43, 46, 50-53"; U.S. Pat. No. 6,100,099, issued Aug. 8, 2000, entitled "TEST STRIP HAVING A DIAGONAL ARRAY OF CAPTURE SPOTS"; U.S. Pat. No. 6,210,898, issued Apr. 3, 2001, entitled "METHOD OF PERFORMING IMMUNOCHROMATOGRAPHY"; U.S. Pat. No. 7,973,015, issued Jul. 5, 2011, entitled "INDUCTION OF EXON SKIPPING IN EUKARYOTIC CELLS"; U.S. Pat. No. 8,039,608, issued Oct. 18, 2011, entitled "BIOINFORMATICALLY DETECTABLE GROUP OF NOVEL REGULATORY GENES AND USES THEREOF"; U.S. Pat. No. 8,361,979, issued Jan. 29, 2013, entitled "MEANS AND METHOD FOR INDUCING EXON-SKIPPING"; U.S. Pat. No. 8,802,437, issued Aug. 12, 2014, entitled "MEGANUCLEASE REAGENTS OF USES THEREOF FOR TREATING GENETIC DISEASES CAUSED BY FRAME SHIFT/NON SENSE MUTATIONS"; U.S. Pat. No. 8,865,883, issued Oct. 21, 2014, entitled "MULTIPLE EXON SKIPPING COMPOSITIONS FOR DMD"; U.S. Pat. No. 9,657,049, issued May 23, 2017, entitled "ENA NUCLEIC ACID PHARMACEUTICALS CAPABLE OF MODIFYING SPLICING OF MRNA PRECURSORS"; U.S. Pat. No. 9,657,050, issued May 23, 2017, entitled "ENA NUCLEIC ACID PHARMACEUTICALS CAPABLE OF MODIFYING SPLICING OF MRNA PRECURSORS"; U.S. Pat. No. 9,988,629, issued Jun. 5, 2018, entitled "ANTISENSE NUCLEIC ACIDS"; International Patent Publication WO 2011/078797 A2, published Jun. 30, 2011, entitled "ANTISENSE OLIGONUCLEOTIDES AND USES THREREOF"; International Patent Publication WO 2011/154427 A1, published Dec. 15, 2011, entitled "MODIFIED SNRNAS FOR USE IN THERAPY"; International Patent Publication WO 2018/007475 A1, published Jan. 11, 2018, entitled "PRE-MRNA SPLICE SWITCHING OR MODULATING OLIGONUCLEOTIDES COMPRISING BICYCLIC SCAFFOLD MOIETIES, WITH IMPROVED CHARACTERISTICS FOR THE TREATMENT OF GENETIC DISORDERS"; International Patent Publication WO 2018/014042 A1, published Jan. 18, 2018, entitled "COMPOUNDS AND METHODS FOR MODULATION OF DYSTROPHIN TRANSCRIPT"; International Patent Publication WO 2018/017754 A1, published Jan. 25, 2018, entitled "THERAPEUTIC APPLICATIONS OF CPF1-BASED GENOME EDITING"; International Patent Publication WO 2018/107003 A1, published Jun. 14, 2018, entitled "DMD REPORTER MODELS CONTAINING HUMANIZED DUSCHENE MUSCULAR DYSTROPHY MUTATIONS"; International Patent Publication WO 2018/129296 A1, published Jul. 12, 2018, entitled "OPTIMIZED STRATEGY FOR EXON SKIPPING MODIFICATIONS USING CRISPR/CAS9 WITH TRIPLE GUIDE SEQUENCES"; International Patent Publication WO 2019/014772 A1, published Jan. 24, 2019, entitled "ANTISENSE OLIGONUCLEOTIDES THAT BIND TO EXON 51 OF HUMAN DYSTROPHIN PRE-MRNA"; International Patent Publication WO 2019/059973 A1, published Mar. 28, 2019, entitled "EXON SKIPPING OLIGOMER CONJUGATES FOR MUSCULAR DYSTROPHY"; International Patent Publication WO 2019/060775 A1, published Mar. 28, 2019, entitled "NUCLEIC ACID-POLYPEPTIDE COMPOSITIONS AND METHODS OF INDUCING EXON SKIPPING"; International Patent Publication WO 2019/067975 A1, published Apr. 4, 2019, entitled "COMBINATION THERAPIES FOR TREATING MUSCULAR DYSTROPHY"; International Patent Publication WO 2019/092507 A2, published May 16, 2019, entitled "CRISPR/CAS SYSTEMS FOR TREATMENT OF DMD"; International Patent Publication WO 2019/136216 A1, published Jul. 11, 2019, entitled "THERAPEUTIC CRISPR/CAS9 COMPOSITIONS AND METHODS OF USE"; International Patent Publication WO 2019/152609 A1, published Aug. 8, 2019, entitled "COMPOSITIONS AND METHODS FOR CORRECTING DYSTROPHIN MUTATIONS IN HUMAN CARDIOMYOCYTES"; International Patent Publication WO 2019/200185 A1, published Oct. 17, 2019, entitled "OLIGONUCLEOTIDE COMPOSITIONS AND METHODS OF USE THEREOF"; International Patent Publication WO 2019/215333 A1, published Nov. 14, 2019, entitled "OLIGONUCLEOTIDES CONJUGATES COMPRISING 7'-5'-ALPHA-ANOMERIC-BICYCLIC SUGAR NUCLEOSIDES"; International Patent Publication WO 2019/241385 A2, published Dec. 19, 2019, entitled "EXON SKIPPING OLIGOMERS FOR MUSCULAR DYSTROPY"; International Patent Publication WO 2019/246480 A1, published Dec. 26, 2019, entitled "CORRECTION OF DYSTROPHIN EXON 43, EXON 45, OR EXON 52 DELETIONS IN DUCHENNE MUSCULAR DYSTROPHY"; International Patent Publication WO 2020/028832 A1, published Feb. 6, 2020, entitled "MUSCLE TARGETING COMPLEXES AND USES THEREOF FOR TREATING DYSTROPHINOPATHIES"; International Patent Publication WO 2018/091544 A1, published May 24, 2018, entitled "SUBSTANCES FOR TARGETING VARIOUS SELECTED ORGANS OR TISSUES"; International Patent Publication WO 2018/098480 A1, published May 31, 2018, entitled "PREVENTION OF MUSCULAR DYSTROPHY BY CRISPR/CPF1-MEDIATED GENE EDITING"; International Patent Publication WO 1993/020227 A1, published Oct. 14, 1993, entitled "METHOD OF MULTIPLEX LIGASE CHAIN REACTION"; International Patent Publication WO 2013/100190 A1, published Jul. 4, 2013, entitled "ANTISENSE NUCLEIC ACID"; International Patent Publication WO 2013/163628 A2, published Oct. 31, 2013, entitled "GENETIC CORRECTION OF MUTATED GENES"; International Patent Publication WO 2007/135105 A1, published Nov. 29, 2007, entitled "MEANS AND METHOD FOR INDUCING EXON-SKIPPING"; International Patent Publication WO 2011/150408 A2, published Dec. 1, 2011, entitled "OLIGONUCLEOTIDE ANALOGUES HAVING MODIFIED INTERSUBUNIT LINKAGES AND/OR TERMINAL GROUPS"; International Patent Publication WO 2012/029986 A1, published Mar. 8, 2012, entitled "ANTISENSE NUCLEIC ACID"; the contents of each of which are incorporated herein in their entireties.

Examples of oligonucleotides for promoting DMD gene editing include International Patent Publication WO2018053632A1, published Mar. 29, 2018, entitled "METHODS OF MODIFYING THE DYSTROPHIN GENE AND RESTORING DYSTROPHIN EXPRESSION AND USES THEREOF"; International Patent Publication WO2017049407A1, published Mar. 30, 2017, entitled "MODIFICATION OF THE DYSTROPHIN GENE AND USES THEREOF"; International Patent Publication WO2016161380A1, published Oct. 6, 2016, entitled "CRISPR/CAS-RELATED METHODS AND COMPOSITIONS FOR TREATING DUCHENNE MUSCULAR DYSTROPHY AND BECKER MUSCULAR DYSTROPHY"; International Patent Publication WO2017095967, published Jun. 8, 2017, entitled "THERAPEUTIC TARGETS FOR THE CORRECTION OF THE HUMAN DYSTROPHIN GENE BY GENE EDITING AND METHODS OF USE"; International Patent Publication WO2017072590A1, published May 4, 2017, entitled "MATERIALS AND METHODS FOR TREATMENT OF DUCHENNE MUSCULAR DYSTROPHY"; International Patent Publication WO2018098480A1, published May 31, 2018, entitled "PREVENTION OF MUSCULAR DYSTROPHY BY CRISPR/CPF1-MEDIATED GENE EDITING"; US Patent Application Publication US20170266320A1, published Sep. 21, 2017, entitled "RNA-Guided Systems for In Vivo Gene Editing"; International Patent Publication WO2016025469A1, published Feb. 18, 2016, entitled "PREVENTION OF MUSCULAR DYSTROPHY BY CRISPR/CAS9-MEDIATED GENE EDITING"; U.S. Patent Application Publication 2016/0201089, published Jul. 14, 2016, entitled "RNA-GUIDED GENE EDITING AND GENE REGULATION"; and U.S. Patent Application Publication 2013/0145487, published Jun. 6, 2013, entitled "MEGANUCLEASE VARIANTS CLEAVING A DNA TARGET SEQUENCE FROM THE DYSTROPHN GENE AND USES THEREOF", the contents of each of which are incorporated herein in their entireties. In some embodiments, an oligonucleotide may have a region of complementarity to DMD gene sequences of multiple species, e.g., selected from human, mouse and non-human species.

In some embodiments, the oligonucleotide may have region of complementarity to a mutant DMD allele, for example, a DMD allele with at least one mutation in any of exons 1-79 of DMD in humans that leads to a frameshift and improper RNA splicing/processing.

In some embodiments, the oligonucleotide may target lncRNA or mRNA, e.g., for degradation. In some embodiments, the oligonucleotide may target, e.g., for degradation, a nucleic acid encoding a protein involved in a mismatch repair pathway, e.g., MSH2, MutLalpha, MutSbeta, MutLalpha. Non-limiting examples of proteins involved in mismatch repair pathways, for which mRNAs encoding such proteins may be targeted by oligonucleotides described herein, are described in Iyer, R. R. et al., "*DNA triplet repeat expansion and mismatch repair*" Annu Rev Biochem. 2015; 84:199-226.; and Schmidt M. H. and Pearson C. E., "Disease-associated repeat instability and mismatch repair" DNA Repair (Amst). 2016 February; 38:117-26.

In some embodiments, any one of the oligonucleotides can be in salt form, e.g., as sodium, potassium, or magnesium salts.

In some embodiments, the 5' or 3' nucleoside (e.g., terminal nucleoside) of any one of the oligonucleotides described herein is conjugated to an amine group, optionally via a spacer. In some embodiments, the spacer comprises an aliphatic moiety. In some embodiments, the spacer comprises a polyethylene glycol moiety. In some embodiments, a phosphodiester linkage is present between the spacer and the 5' or 3' nucleoside of the oligonucleotide. In some embodiments, the 5' or 3' nucleoside (e.g., terminal nucleoside) of any of the oligonucleotides described herein is conjugated to a spacer that is a substituted or unsubstituted aliphatic, substituted or unsubstituted heteroaliphatic, substituted or unsubstituted carbocyclylene, substituted or unsubstituted heterocyclylene, substituted or unsubstituted arylene, substituted or unsubstituted heteroarylene, —O—, —N(R$^A$)—, —S—, —C(=O)—, —C(=O)O—, —C(=O)NR$^A$—, —NR$^A$C(=O)—, —NR$^A$C(=O)R$^A$—, —C(=O)R$^A$—, —NR$^A$C(=O)O—, —NR$^A$C(=O)N(R$^A$)—, —OC(=O)—, —OC(=O)O—, —OC(=O)N(R$^A$)—, —S(O)$_2$NR$^A$, —NR$^A$S(O)$_2$—, or a combination thereof; each R$^A$ is independently hydrogen or substituted or unsubstituted alkyl. In certain embodiments, the spacer is a substituted or unsubstituted alkylene, substituted or unsubstituted heterocyclylene, substituted or unsubstituted heteroarylene, —O—, —N(R$^A$)—, or —C(=O)N(R$^A$)$_2$, or a combination thereof.

In some embodiments, the 5' or 3' nucleoside of any one of the oligonucleotides described herein is conjugated to a compound of the formula —NH$_2$—(CH$_2$)$_n$—, wherein n is an integer from 1 to 12. In some embodiments, n is 6, 7, 8, 9, 10, 11, or 12. In some embodiments, a phosphodiester linkage is present between the compound of the formula NH$_2$—(CH$_2$)$_n$— and the 5' or 3' nucleoside of the oligonucleotide. In some embodiments, a compound of the formula NH$_2$—(CH$_2$)$_6$— is conjugated to the oligonucleotide via a reaction between 6-amino-1-hexanol (NH$_2$—(CH$_2$)$_6$—OH) and the 5' phosphate of the oligonucleotide.

In some embodiments, the oligonucleotide is conjugated to a targeting agent, e.g., a muscle targeting agent such as an anti-TfR antibody, e.g., via the amine group.

a. Oligonucleotide Size/Sequence

Oligonucleotides may be of a variety of different lengths, e.g., depending on the format. In some embodiments, an oligonucleotide is 7, 8, 9, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, the oligonucleotide is 8 to 50 nucleotides in length, 8 to 40 nucleotides in length, 8 to 30 nucleotides in length, 10 to 15 nucleotides in length, 10 to 20 nucleotides in length, 15 to 25 nucleotides in length, 21 to 23 nucleotides in lengths, etc.

In some embodiments, a complementary nucleic acid sequence of an oligonucleotide for purposes of the present disclosure is specifically hybridizable or specific for the target nucleic acid when binding of the sequence to the target molecule (e.g., mRNA) interferes with the function of the target (e.g., mRNA) to cause a change of activity (e.g., inhibiting translation, altering splicing, exon skipping) or expression (e.g., degrading a target mRNA) and there is a sufficient degree of complementarity to avoid non-specific binding of the sequence to non-target sequences under conditions in which avoidance of non-specific binding is desired, e.g., under physiological conditions in the case of in vivo assays or therapeutic treatment, and in the case of in vitro assays, under conditions in which the assays are performed under suitable conditions of stringency. Thus, in some embodiments, an oligonucleotide may be at least 80%, at least 85%, at least 90%, at least 91%, at least 92%, at least 93%, at least 94%, at least 95%, at least 96%, at least 97%, at least 98%, at least 99% or 100% complementary to the consecutive nucleotides of a target nucleic acid. In some embodiments a complementary nucleotide sequence need not be 100% complementary to that of its target to be specifically hybridizable or specific for a target nucleic acid.

In some embodiments, an oligonucleotide comprises region of complementarity to a target nucleic acid that is in the range of 8 to 15, 8 to 30, 8 to 40, or 10 to 50, or 5 to 50, or 5 to 40 nucleotides in length. In some embodiments, a region of complementarity of an oligonucleotide to a target nucleic acid is 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length. In some embodiments, the region of complementarity is complementary with at least 8 consecutive nucleotides of a target nucleic acid. In some embodiments, an oligonucleotide may contain 1, 2 or 3 base mismatches compared to the portion of the consecutive nucleotides of target nucleic acid. In some embodiments the oligonucleotide may have up to 3 mismatches over 15 bases, or up to 2 mismatches over 10 bases.

In some embodiments, the oligonucleotide is complementary (e.g., at least 85% at least 90%, at least 95%, or 100%) to a target sequence of the any one of the oligonucleotides described herein (e.g., the oligonucleotides listed in Table 14). In some embodiments, the oligonucleotide is complementary (e.g., at least 85% at least 90%, at least 95%, or 100%) to a target sequence of the any one of the oligonucleotides provided by SEQ ID NO: 437-1241. In some embodiments, such target sequence is 100% complementary to an oligonucleotide listed in Table 14. In some embodiments, such target sequence is 100% complementary to an oligonucleotide provided by SEQ ID NO: 437-1241. In some embodiments, the oligonucleotide is complementary (e.g., at least 85% at least 90%, at least 95%, or 100%) to a target sequence provided herein (e.g., a target sequence of any one of the oligonucleotides listed in Table 14). In some embodiments, the oligonucleotide is complementary (e.g., at least 85% at least 90%, at least 95%, or 100%) to a target sequence of any one of the oligonucleotides provided by SEQ ID NO: 1242-2046.

In some embodiments, any one or more of the thymine bases (T's) in any one of the oligonucleotides provided herein (e.g., the oligonucleotides listed in Table 14) may optionally be uracil bases (U's), and/or any one or more of the U's in the oligonucleotides provided herein may optionally be T's. In some embodiments, any one or more of the thymine bases (T's) in any one of the oligonucleotides provided by SEQ ID NOs: 437-1241 or in an oligonucleotide complementary to any one of SEQ ID NOs: 1242-2046 may optionally be uracil bases (U's), and/or any one or more of the U's in the oligonucleotides may optionally be T's.

b. Oligonucleotide Modifications:

The oligonucleotides described herein may be modified, e.g., comprise a modified sugar moiety, a modified internucleoside linkage, a modified nucleotide and/or (e.g., and) combinations thereof. In addition, in some embodiments, oligonucleotides may exhibit one or more of the following properties: do not mediate alternative splicing; are not immune stimulatory; are nuclease resistant; have improved cell uptake compared to unmodified oligonucleotides; are not toxic to cells or mammals; have improved endosomal exit internally in a cell; minimizes TLR stimulation; or avoid pattern recognition receptors. Any of the modified chemistries or formats of oligonucleotides described herein can be combined with each other. For example, one, two, three, four, five, or more different types of modifications can be included within the same oligonucleotide.

In some embodiments, certain nucleotide modifications may be used that make an oligonucleotide into which they are incorporated more resistant to nuclease digestion than the native oligodeoxynucleotide or oligoribonucleotide molecules; these modified oligonucleotides survive intact for a longer time than unmodified oligonucleotides. Specific examples of modified oligonucleotides include those comprising modified backbones, for example, modified internucleoside linkages such as phosphorothioates, phosphotriesters, methyl phosphonates, short chain alkyl or cycloalkyl intersugar linkages or short chain heteroatomic or heterocyclic intersugar linkages. Accordingly, oligonucleotides of the disclosure can be stabilized against nucleolytic degradation such as by the incorporation of a modification, e.g., a nucleotide modification.

In some embodiments, an oligonucleotide may be of up to 50 or up to 100 nucleotides in length in which 2 to 10, 2 to 15, 2 to 16, 2 to 17, 2 to 18, 2 to 19, 2 to 20, 2 to 25, 2 to 30, 2 to 40, 2 to 45, or more nucleotides of the oligonucleotide are modified nucleotides. The oligonucleotide may be of 8 to 30 nucleotides in length in which 2 to 10, 2 to 15, 2 to 16, 2 to 17, 2 to 18, 2 to 19, 2 to 20, 2 to 25, 2 to 30 nucleotides of the oligonucleotide are modified nucleotides. The oligonucleotide may be of 8 to 15 nucleotides in length in which 2 to 4, 2 to 5, 2 to 6, 2 to 7, 2 to 8, 2 to 9, 2 to 10, 2 to 11, 2 to 12, 2 to 13, 2 to 14 nucleotides of the oligonucleotide are modified nucleotides. Optionally, the oligonucleotides may have every nucleotide except 1, 2, 3, 4, 5, 6, 7, 8, 9, or 10 nucleotides modified. Oligonucleotide modifications are described further herein.

c. Modified Nucleosides

In some embodiments, the oligonucleotide described herein comprises at least one nucleoside modified at the 2' position of the sugar. In some embodiments, an oligonucleotide comprises at least one 2'-modified nucleoside. In some embodiments, all of the nucleosides in the oligonucleotide are 2'-modified nucleosides.

In some embodiments, the oligonucleotide described herein comprises one or more non-bicyclic 2'-modified nucleosides, e.g., 2'-deoxy, 2'-fluoro (2'-F), 2'-O-methyl (2'-O-Me), 2'-O-methoxyethyl (2'-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA) modified nucleoside.

In some embodiments, the oligonucleotide described herein comprises one or more 2'-4' bicyclic nucleosides in which the ribose ring comprises a bridge moiety connecting two atoms in the ring, e.g., connecting the 2'-O atom to the 4'-C atom via a methylene (LNA) bridge, an ethylene (ENA) bridge, or a (S)-constrained ethyl (cEt) bridge. Examples of LNAs are described in International Patent Application Publication WO/2008/043753, published on Apr. 17, 2008, and entitled "*RNA Antagonist Compounds For The Modulation Of PCSK9*", the contents of which are incorporated herein by reference in its entirety. Examples of ENAs are provided in International Patent Publication No. WO 2005/042777, published on May 12, 2005, and entitled "*APP/ENA Antisense*"; Morita et al., Nucleic Acid Res., Suppl 1:241-242, 2001; Surono et al., Hum. Gene Ther., 15:749-757, 2004; Koizumi, Curr. Opin. Mol. Ther., 8:144-149, 2006 and Horie et al., Nucleic Acids Symp. Ser (Oxf), 49:171-172, 2005; the disclosures of which are incorporated herein by reference in their entireties. Examples of cEt are provided in U.S. Pat. Nos. 7,101,993; 7,399,845 and 7,569,686, each of which is herein incorporated by reference in its entirety.

In some embodiments, the oligonucleotide comprises a modified nucleoside disclosed in one of the following United States patent or patent application Publications: U.S. Pat. No. 7,399,845, issued on Jul. 15, 2008, and entitled "6-Modified Bicyclic Nucleic Acid Analogs"; U.S. Pat. No. 7,741,457, issued on Jun. 22, 2010, and entitled "6-Modified Bicyclic Nucleic Acid Analogs"; U.S. Pat. No. 8,022,193, issued on Sep. 20, 2011, and entitled "6-Modified Bicyclic Nucleic Acid Analogs"; U.S. Pat. No. 7,569,686, issued on Aug. 4, 2009, and entitled "Compounds And Methods For Synthesis Of Bicyclic Nucleic Acid Analogs"; U.S. Pat. No. 7,335,765, issued on Feb. 26, 2008, and entitled "Novel Nucleoside And Oligonucleotide Analogues"; U.S. Pat. No. 7,314,923, issued on Jan. 1, 2008, and entitled "Novel Nucleoside And Oligonucleotide Analogues"; U.S. Pat. No. 7,816,333, issued on Oct. 19, 2010, and entitled "Oligonucleotide Analogues And Methods Utilizing The Same" and US Publication Number 2011/0009471 now U.S. Pat. No. 8,957,201, issued on Feb. 17, 2015, and entitled "Oligonucleotide Analogues And Methods Utilizing The Same", the entire contents of each of which are incorporated herein by reference for all purposes.

In some embodiments, the oligonucleotide comprises at least one modified nucleoside that results in an increase in Tm of the oligonucleotide in a range of 1° C., 2° C., 3° C., 4° C., or 5° C. compared with an oligonucleotide that does not have the at least one modified nucleoside. The oligonucleotide may have a plurality of modified nucleosides that result in a total increase in Tm of the oligonucleotide in a range of 2° C., 3° C., 4° C., 5° C., 6° C., 7° C., 8° C., 9° C., 10° C., 15° C., 20° C., 25° C., 30° C., 35° C., 40° C., 45° C. or more compared with an oligonucleotide that does not have the modified nucleoside.

The oligonucleotide may comprise a mix of nucleosides of different kinds. For example, an oligonucleotide may comprise a mix of 2'-deoxyribonucleosides or ribonucleosides and 2'-fluoro modified nucleosides. An oligonucleotide may comprise a mix of deoxyribonucleosides or ribonucleosides and 2'-O-Me modified nucleosides. An oligonucleotide may comprise a mix of 2'-fluoro modified nucleosides and 2'-O-Me modified nucleosides. An oligonucleotide may comprise a mix of 2'-4' bicyclic nucleosides and 2'-MOE, 2'-fluoro, or 2'-O-Me modified nucleosides. An oligonucleotide may comprise a mix of non-bicyclic 2'-modified nucleosides (e.g., 2'-MOE, 2'-fluoro, or 2'-O-Me) and 2'-4' bicyclic nucleosides (e.g., LNA, ENA, cEt).

The oligonucleotide may comprise alternating nucleosides of different kinds. For example, an oligonucleotide may comprise alternating 2'-deoxyribonucleosides or ribonucleosides and 2'-fluoro modified nucleosides. An oligonucleotide may comprise alternating deoxyribonucleosides or ribonucleosides and 2'-O-Me modified nucleosides. An oligonucleotide may comprise alternating 2'-fluoro modified nucleosides and 2'-O-Me modified nucleosides. An oligonucleotide may comprise alternating 2'-4' bicyclic nucleosides and 2'-MOE, 2'-fluoro, or 2'-O-Me modified nucleosides. An oligonucleotide may comprise alternating non-bicyclic 2'-modified nucleosides (e.g., 2'-MOE, 2'-fluoro, or 2'-O-Me) and 2'-4' bicyclic nucleosides (e.g., LNA, ENA, cEt).

In some embodiments, an oligonucleotide described herein comprises a 5'-vinylphosphonate modification, one or more abasic residues, and/or one or more inverted abasic residues.

d. Internucleoside Linkages/Backbones

In some embodiments, oligonucleotide may contain a phosphorothioate or other modified internucleoside linkage. In some embodiments, the oligonucleotide comprises phosphorothioate internucleoside linkages. In some embodiments, the oligonucleotide comprises phosphorothioate internucleoside linkages between at least two nucleotides. In some embodiments, the oligonucleotide comprises phosphorothioate internucleoside linkages between all nucleotides. For example, in some embodiments, oligonucleotides comprise modified internucleoside linkages at the first, second, and/or (e.g., and) third internucleoside linkage at the 5' or 3' end of the nucleotide sequence.

Phosphorus-containing linkages that may be used include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

In some embodiments, oligonucleotides may have heteroatom backbones, such as methylene(methylimino) or MMI backbones; amide backbones (see De Mesmaeker et al. Acc. Chem. Res. 1995, 28:366-374); morpholino backbones (see Summerton and Weller, U.S. Pat. No. 5,034,506); or peptide nucleic acid (PNA) backbones (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497).

e. Stereospecific Oligonucleotides

In some embodiments, internucleotidic phosphorus atoms of oligonucleotides are chiral, and the properties of the oligonucleotides by adjusted based on the configuration of the chiral phosphorus atoms. In some embodiments, appropriate methods may be used to synthesize P-chiral oligonucleotide analogs in a stereocontrolled manner (e.g., as described in Oka N, Wada T, Stereocontrolled synthesis of oligonucleotide analogs containing chiral internucleotidic phosphorus atoms. Chem Soc Rev. 2011 December; 40 (12): 5829-43.) In some embodiments, phosphorothioate containing oligonucleotides comprise nucleoside units that are joined together by either substantially all Sp or substantially all Rp phosphorothioate intersugar linkages are provided. In some embodiments, such phosphorothioate oligonucleotides having substantially chirally pure intersugar linkages are prepared by enzymatic or chemical synthesis, as described, for example, in U.S. Pat. No. 5,587,261, issued on Dec. 12, 1996, the contents of which are incorporated herein by reference in their entirety. In some embodiments, chirally controlled oligonucleotides provide selective cleavage patterns of a target nucleic acid. For example, in some embodiments, a chirally controlled oligonucleotide provides single site cleavage within a complementary sequence of a nucleic acid, as described, for example, in US Patent Application Publication 20170037399 A1, published on Feb. 2, 2017, entitled "CHIRAL DESIGN", the contents of which are incorporated herein by reference in their entirety.

f. Morpholinos

In some embodiments, the oligonucleotide may be a morpholino-based compounds. Morpholino-based oligomeric compounds are described in Dwaine A. Braasch and David R. Corey, Biochemistry, 2002, 41 (14), 4503-4510); Genesis, volume 30, issue 3, 2001; Heasman, J., Dev. Biol., 2002, 243, 209-214; Nasevicius et al., Nat. Genet., 2000, 26, 216-220; Lacerra et al., Proc. Natl. Acad. Sci., 2000, 97, 9591-9596; and U.S. Pat. No. 5,034,506, issued Jul. 23, 1991. In some embodiments, the morpholino-based oligomeric compound is a phosphorodiamidate morpholino oligomer (PMO) (e.g., as described in Iverson, Curr. Opin. Mol. Ther., 3:235-238, 2001; and Wang et al., J. Gene Med., 12:354-364, 2010; the disclosures of which are incorporated herein by reference in their entireties).

g. Peptide Nucleic Acids (PNAS)

In some embodiments, both a sugar and an internucleoside linkage (the backbone) of the nucleotide units of an oligonucleotide are replaced with novel groups. In some embodiments, the base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative publication that report the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al., Science, 1991, 254, 1497-1500.

h. Gapmers

In some embodiments, an oligonucleotide described herein is a gapmer. A gapmer oligonucleotide generally has the formula 5'-X-Y-Z-3', with X and Z as flanking regions around a gap region Y. In some embodiments, flanking region X of formula 5'-X-Y-Z-3' is also referred to as X region, flanking sequence X, 5' wing region X, or 5' wing segment. In some embodiments, flanking region Z of formula 5'-X-Y-Z-3' is also referred to as Z region, flanking sequence Z, 3' wing region Z, or 3' wing segment. In some embodiments, gap region Y of formula 5'-X-Y-Z-3' is also referred to as Y region, Y segment, or gap-segment Y. In some embodiments, each nucleoside in the gap region Y is a 2'-deoxyribonucleoside, and neither the 5' wing region X or the 3' wing region Z contains any 2'-deoxyribonucleosides.

In some embodiments, the Y region is a contiguous stretch of nucleotides, e.g., a region of 6 or more DNA nucleotides, which are capable of recruiting an RNAse, such as RNAse H. In some embodiments, the gapmer binds to the target nucleic acid, at which point an RNAse is recruited and can then cleave the target nucleic acid. In some embodiments, the Y region is flanked both 5' and 3' by regions X and Z comprising high-affinity modified nucleosides, e.g., one to six high-affinity modified nucleosides. Examples of high affinity modified nucleosides include, but are not limited to, 2'-modified nucleosides (e.g., 2'-MOE, 2'O-Mc, 2'-F) or 2'-4' bicyclic nucleosides (e.g., LNA, cEt, ENA). In some embodiments, the flanking sequences X and Z may be of 1-20 nucleotides, 1-8 nucleotides, or 1-5 nucleotides in length. The flanking sequences X and Z may be of similar length or of dissimilar lengths. In some embodiments, the gap-segment Y may be a nucleotide sequence of 5-20 nucleotides, 5-15 twelve nucleotides, or 6-10 nucleotides in length.

In some embodiments, the gap region of the gapmer oligonucleotides may contain modified nucleotides known to be acceptable for efficient RNase H action in addition to DNA nucleotides, such as C4'-substituted nucleotides, acyclic nucleotides, and arabino-configured nucleotides. In some embodiments, the gap region comprises one or more unmodified internucleosides. In some embodiments, one or both flanking regions each independently comprise one or more phosphorothioate internucleoside linkages (e.g., phosphorothioate internucleoside linkages or other linkages) between at least two, at least three, at least four, at least five or more nucleotides. In some embodiments, the gap region and two flanking regions each independently comprise modified internucleoside linkages (e.g., phosphorothioate internucleoside linkages or other linkages) between at least two, at least three, at least four, at least five or more nucleotides.

A gapmer may be produced using appropriate methods. Representative U.S. patents, U.S. patent publications, and PCT publications that teach the preparation of gapmers include, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; 5,700,922; 5,898,031; 7,015,315; 7,101,993; 7,399,845; 7,432,250; 7,569,686; 7,683,036; 7,750,131; 8,580,756; 9,045,754; 9,428,534; 9,695,418; 10,017,764; 10,260,069; 9,428,534; 8,580,756; U.S. patent publication Nos. US20050074801, US20090221685; US20090286969, US20100197762, and US20110112170; PCT publication Nos. WO2004069991; WO2005023825; WO2008049085 and WO2009090182; and EP Patent No. EP2, 149,605, each of which is herein incorporated by reference in its entirety.

In some embodiments, a gapmer is 10-40 nucleosides in length. For example, a gapmer may be 10-40, 10-35, 10-30, 10-25, 10-20, 10-15, 15-40, 15-35, 15-30, 15-25, 15-20, 20-40, 20-35, 20-30, 20-25, 25-40, 25-35, 25-30, 30-40, 30-35, or 35-40 nucleosides in length. In some embodiments, a gapmer is 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleosides in length.

In some embodiments, the gap region Y in a gapmer is 5-20 nucleosides in length. For example, the gap region Y may be 5-20, 5-15, 5-10, 10-20, 10-15, or 15-20 nucleosides in length. In some embodiments, the gap region Y is 5, 6, 7, 8, 9, 10, 11, 12, 13, 14, 15, 16, 17, 18, 19, or 20 nucleosides in length. In some embodiments, each nucleoside in the gap region Y is a 2'-deoxyribonucleoside. In some embodiments, all nucleosides in the gap region Y are 2'-deoxyribonucleosides. In some embodiments, one or more of the nucleosides in the gap region Y is a modified nucleoside (e.g., a 2' modified nucleoside such as those described herein). In some embodiments, one or more cytosines in the gap region Y are optionally 5-methyl-cytosines. In some embodiments, each cytosine in the gap region Y is a 5-methyl-cytosines.

In some embodiments, the 5' wing region of a gapmer (X in the 5'-X-Y-Z-3' formula) and the 3' wing region of a gapmer (Z in the 5'-X-Y-Z-3' formula) are independently 1-20 nucleosides long. For example, the 5' wing region of a gapmer (X in the 5'-X-Y-Z-3' formula) and the 3' wing region of the gapmer (Z in the 5'-X-Y-Z-3' formula) may be independently 1-20, 1-15, 1-10, 1-7, 1-5, 1-3, 1-2, 2-5, 2-7, 3-5, 3-7, 5-20, 5-15, 5-10, 10-20, 10-15, or 15-20 nucleosides long. In some embodiments, the 5' wing region of the gapmer (X in the 5'-X-Y-Z-3' formula) and the 3' wing region of the gapmer (Z in the 5'-X-Y-Z-3' formula) are independently 1, 2, 3, 4, 5, 6, 7, 8, 9, 10, 11, 12, 13, 14, 15, 16, 17, 18, 19, or 20 nucleosides long. In some embodiments, the 5' wing region of the gapmer (X in the 5'-X-Y-Z-3' formula) and the 3' wing region of the gapmer (Z in the 5'-X-Y-Z-3' formula) are of the same length. In some embodiments, the 5' wing region of the gapmer (X in the 5'-X-Y-Z-3' formula) and the 3' wing region of the gapmer (Z in the 5'-X-Y-Z-3' formula) are of different lengths. In some embodiments, the 5' wing region of the gapmer (X in the 5'-X-Y-Z-3' formula) is longer than the 3' wing region of the gapmer (Z in the 5'-X-Y-Z-3' formula). In some embodiments, the 5' wing region of the gapmer (X in the 5'-X-Y-

Z-3' formula) is shorter than the 3' wing region of the gapmer (Z in the 5'-X-Y-Z-3' formula).

In some embodiments, a gapmer comprises a 5'-X-Y-Z-3' of 5-10-5, 4-12-4, 3-14-3, 2-16-2, 1-18-1, 3-10-3, 2-10-2, 1-10-1, 2-8-2, 4-6-4, 3-6-3, 2-6-2, 4-7-4, 3-7-3, 2-7-2, 4-8-4, 3-8-3, 2-8-2, 1-8-1, 2-9-2, 1-9-1, 2-10-2, 1-10-1, 1-12-1, 1-16-1, 2-15-1, 1-15-2, 1-14-3, 3-14-1, 2-14-2, 1-13-4, 4-13-1, 2-13-3, 3-13-2, 1-12-5, 5-12-1, 2-12-4, 4-12-2, 3-12-3, 1-11-6, 6-11-1, 2-11-5, 5-11-2, 3-11-4, 4-11-3, 1-17-1, 2-16-1, 1-16-2, 1-15-3, 3-15-1, 2-15-2, 1-14-4, 4-14-1, 2-14-3, 3-14-2, 1-13-5, 5-13-1, 2-13-4, 4-13-2, 3-13-3, 1-12-6, 6-12-1, 2-12-5, 5-12-2, 3-12-4, 4-12-3, 1-11-7, 7-11-1, 2-11-6, 6-11-2, 3-11-5, 5-11-3, 4-11-4, 1-18-1, 1-17-2, 2-17-1, 1-16-3, 1-16-3, 2-16-2, 1-15-4, 4-15-1, 2-15-3, 3-15-2, 1-14-5, 5-14-1, 2-14-4, 4-14-2, 3-14-3, 1-13-6, 6-13-1, 2-13-5, 5-13-2, 3-13-4, 4-13-3, 1-12-7, 7-12-1, 2-12-6, 6-12-2, 3-12-5, 5-12-3, 1-11-8, 8-11-1, 2-11-7, 7-11-2, 3-11-6, 6-11-3, 4-11-5, 5-11-4, 1-18-1, 1-17-2, 2-17-1, 1-16-3, 3-16-1, 2-16-2, 1-15-4, 4-15-1, 2-15-3, 3-15-2, 1-14-5, 2-14-4, 4-14-2, 3-14-3, 1-13-6, 6-13-1, 2-13-5, 5-13-2, 3-13-4, 4-13-3, 1-12-7, 7-12-1, 2-12-6, 6-12-2, 3-12-5, 5-12-3, 1-11-8, 8-11-1, 2-11-7, 7-11-2, 3-11-6, 6-11-3, 4-11-5, 5-11-4, 1-19-1, 1-18-2, 2-18-1, 1-17-3, 3-17-1, 2-17-2, 1-16-4, 4-16-1, 2-16-3, 3-16-2, 1-15-5, 2-15-4, 4-15-2, 3-15-3, 1-14-6, 6-14-1, 2-14-5, 5-14-2, 3-14-4, 4-14-3, 1-13-7, 7-13-1, 2-13-6, 6-13-2, 3-13-5, 5-13-3, 4-13-4, 1-12-8, 8-12-1, 2-12-7, 7-12-2, 3-12-6, 6-12-3, 4-12-5, 5-12-4, 2-11-8, 8-11-2, 3-11-7, 7-11-3, 4-11-6, 6-11-4, 5-11-5, 1-20-1, 1-19-2, 2-19-1, 1-18-3, 3-18-1, 2-18-2, 1-17-4, 4-17-1, 2-17-3, 3-17-2, 1-16-5, 2-16-4, 4-16-2, 3-16-3, 1-15-6, 6-15-1, 2-15-5, 5-15-2, 3-15-4, 4-15-3, 1-14-7, 7-14-1, 2-14-6, 6-14-2, 3-14-5, 5-14-3, 4-14-4, 1-13-8, 8-13-1, 2-13-7, 7-13-2, 3-13-6, 6-13-3, 4-13-5, 5-13-4, 2-12-8, 8-12-2, 3-12-7, 7-12-3, 4-12-6, 6-12-4, 5-12-5, 3-11-8, 8-11-3, 4-11-7, 7-11-4, 5-11-6, 6-11-5, 1-21-1, 1-20-2, 2-20-1, 1-20-3, 3-19-1, 2-19-2, 1-18-4, 4-18-1, 2-18-3, 3-18-2, 1-17-5, 2-17-4, 4-17-2, 3-17-3, 1-16-6, 6-16-1, 2-16-5, 5-16-2, 3-16-4, 4-16-3, 1-15-7, 7-15-1, 2-15-6, 6-15-2, 3-15-5, 5-15-3, 4-15-4, 1-14-8, 8-14-1, 2-14-7, 7-14-2, 3-14-6, 6-14-3, 4-14-5, 5-14-4, 2-13-8, 8-13-2, 3-13-7, 7-13-3, 4-13-6, 6-13-4, 5-13-5, Jan. 12, 2010, 10-12-1, 2-12-9, 9-12-2, 3-12-8, 8-12-3, 4-12-7, 7-12-4, 5-12-6, 6-12-5, 4-11-8, 8-11-4, 5-11-7, 7-11-5, 6-11-6, 1-22-1, 1-21-2, 2-21-1, 1-21-3, 3-20-1, 2-20-2, 1-19-4, 4-19-1, 2-19-3, 3-19-2, 1-18-5, 2-18-4, 4-18-2, 3-18-3, 1-17-6, 6-17-1, 2-17-5, 5-17-2, 3-17-4, 4-17-3, 1-16-7, 7-16-1, 2-16-6, 6-16-2, 3-16-5, 5-16-3, 4-16-4, 1-15-8, 8-15-1, 2-15-7, 7-15-2, 3-15-6, 6-15-3, 4-15-5, 5-15-4, 2-14-8, 8-14-2, 3-14-7, 7-14-3, 4-14-6, 6-14-4, 5-14-5, 3-13-8, 8-13-3, 4-13-7, 7-13-4, 5-13-6, 6-13-5, 4-12-8, 8-12-4, 5-12-7, 7-12-5, 6-12-6, 5-11-8, 8-11-5, 6-11-7, or 7-11-6. The numbers indicate the number of nucleosides in X, Y, and Z regions in the 5'-X-Y-Z-3' gapmer.

In some embodiments, one or more nucleosides in the 5' wing region of a gapmer (X in the 5'-X-Y-Z-3' formula) or the 3' wing region of a gapmer (Z in the 5'-X-Y-Z-3' formula) are modified nucleotides (e.g., high-affinity modified nucleosides). In some embodiments, the modified nucleoside (e.g., high-affinity modified nucleosides) is a 2'-modified nucleoside. In some embodiments, the 2'-modified nucleoside is a 2'-4' bicyclic nucleoside or a non-bicyclic 2'-modified nucleoside. In some embodiments, the high-affinity modified nucleoside is a 2'-4' bicyclic nucleoside (e.g., LNA, cEt, or ENA) or a non-bicyclic 2'-modified nucleoside (e.g., 2'-fluoro (2'-F), 2'-O-methyl (2'-O-Me), 2'-O-methoxyethyl (2'-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA)).

In some embodiments, one or more nucleosides in the 5' wing region of a gapmer (X in the 5'-X-Y-Z-3' formula) are high-affinity modified nucleosides. In some embodiments, each nucleoside in the 5' wing region of the gapmer (X in the 5'-X-Y-Z-3' formula) is a high-affinity modified nucleoside. In some embodiments, one or more nucleosides in the 3' wing region of a gapmer (Z in the 5'-X-Y-Z-3' formula) are high-affinity modified nucleosides. In some embodiments, each nucleoside in the 3' wing region of the gapmer (Z in the 5'-X-Y-Z-3' formula) is a high-affinity modified nucleoside. In some embodiments, one or more nucleosides in the 5' wing region of the gapmer (X in the 5'-X-Y-Z-3' formula) are high-affinity modified nucleosides and one or more nucleosides in the 3' wing region of the gapmer (Z in the 5'-X-Y-Z-3' formula) are high-affinity modified nucleosides. In some embodiments, each nucleoside in the 5' wing region of the gapmer (X in the 5'-X-Y-Z-3' formula) is a high-affinity modified nucleoside and each nucleoside in the 3' wing region of the gapmer (Z in the 5'-X-Y-Z-3' formula) is high-affinity modified nucleoside.

In some embodiments, the 5' wing region of a gapmer (X in the 5'-X-Y-Z-3' formula) comprises the same high affinity nucleosides as the 3' wing region of the gapmer (Z in the 5'-X-Y-Z-3' formula). For example, the 5' wing region of the gapmer (X in the 5'-X-Y-Z-3' formula) and the 3' wing region of the gapmer (Z in the 5'-X-Y-Z-3' formula) may comprise one or more non-bicyclic 2'-modified nucleosides (e.g., 2'-MOE or 2'-O-Me). In another example, the 5' wing region of the gapmer (X in the 5'-X-Y-Z-3' formula) and the 3' wing region of the gapmer (Z in the 5'-X-Y-Z-3' formula) may comprise one or more 2'-4' bicyclic nucleosides (e.g., LNA or cEt). In some embodiments, each nucleoside in the 5' wing region of the gapmer (X in the 5'-X-Y-Z-3' formula) and the 3' wing region of the gapmer (Z in the 5'-X-Y-Z-3' formula) is a non-bicyclic 2'-modified nucleosides (e.g., 2'-MOE or 2'-O-Mc). In some embodiments, each nucleoside in the 5' wing region of the gapmer (X in the 5'-X-Y-Z-3' formula) and the 3' wing region of the gapmer (Z in the 5'-X-Y-Z-3' formula) is a 2'-4' bicyclic nucleosides (e.g., LNA or cEt).

In some embodiments, a gapmer comprises a 5'-X-Y-Z-3' configuration, wherein X and Z is independently 1-7 (e.g., 1, 2, 3, 4, 5, 6, or 7) nucleosides in length and Y is 6-10 (e.g., 6, 7, 8, 9, or 10) nucleosides in length, wherein each nucleoside in X and Z is a non-bicyclic 2'-modified nucleosides (e.g., 2'-MOE or 2'-O-Me) and each nucleoside in Y is a 2'-deoxyribonucleoside. In some embodiments, the gapmer comprises a 5'-X-Y-Z-3' configuration, wherein X and Z is independently 1-7 (e.g., 1, 2, 3, 4, 5, 6, or 7) nucleosides in length and Y is 6-10 (e.g., 6, 7, 8, 9, or 10) nucleosides in length, wherein each nucleoside in X and Z is a 2'-4' bicyclic nucleosides (e.g., LNA or cEt) and each nucleoside in Y is a 2'-deoxyribonucleoside. In some embodiments, the 5' wing region of the gapmer (X in the 5'-X-Y-Z-3' formula) comprises different high affinity nucleosides as the 3' wing region of the gapmer (Z in the 5'-X-Y-Z-3' formula). For example, the 5' wing region of the gapmer (X in the 5'-X-Y-Z-3' formula) may comprise one or more non-bicyclic 2'-modified nucleosides (e.g., 2'-MOE or 2'-O-Me) and the 3' wing region of the gapmer (Z in the 5'-X-Y-Z-3' formula) may comprise one or more 2'-4' bicyclic nucleosides (e.g., LNA or cEt). In another example, the 3' wing region of the gapmer (Z in the 5'-X-Y-Z-3' formula) may comprise one or more non-bicyclic 2'-modified nucleosides (e.g., 2'-MOE or 2'-O-Me) and the 5' wing region of the gapmer (X in the 5'-X-Y-Z-3' formula) may comprise one or more 2'-4' bicyclic nucleosides (e.g., LNA or cEt).

In some embodiments, a gapmer comprises a 5'-X-Y-Z-3' configuration, wherein X and Z is independently 1-7 (e.g., 1, 2, 3, 4, 5, 6, or 7) nucleosides in length and Y is 6-10 (e.g., 6, 7, 8, 9, or 10) nucleosides in length, wherein each nucleoside in X is a non-bicyclic 2'-modified nucleosides (e.g., 2'-MOE or 2'-O-Me), each nucleoside in Z is a 2'-4' bicyclic nucleosides (e.g., LNA or cEt), and each nucleoside in Y is a 2'-deoxyribonucleoside. In some embodiments, the gapmer comprises a 5'-X-Y-Z-3' configuration, wherein X and Z is independently 1-7 (e.g., 1, 2, 3, 4, 5, 6, or 7) nucleosides in length and Y is 6-10 (e.g., 6, 7, 8, 9, or 10) nucleosides in length, wherein each nucleoside in X is a 2'-4' bicyclic nucleosides (e.g., LNA or cEt), each nucleoside in Z is a non-bicyclic 2'-modified nucleosides (e.g., 2'-MOE or 2'-O-Me) and each nucleoside in Y is a 2'-deoxyribonucleoside.

In some embodiments, the 5' wing region of a gapmer (X in the 5'-X-Y-Z-3' formula) comprises one or more non-bicyclic 2'-modified nucleosides (e.g., 2'-MOE or 2'-O-Me) and one or more 2'-4' bicyclic nucleosides (e.g., LNA or cEt). In some embodiments, the 3' wing region of the gapmer (Z in the 5'-X-Y-Z-3' formula) comprises one or more non-bicyclic 2'-modified nucleosides (e.g., 2'-MOE or 2'-O-Me) and one or more 2'-4' bicyclic nucleosides (e.g., LNA or cEt). In some embodiments, both the 5' wing region of the gapmer (X in the 5'-X-Y-Z-3' formula) and the 3' wing region of the gapmer (Z in the 5'-X-Y-Z-3' formula) comprise one or more non-bicyclic 2'-modified nucleosides (e.g., 2'-MOE or 2'-O-Me) and one or more 2'-4' bicyclic nucleosides (e.g., LNA or cEt).

In some embodiments, a gapmer comprises a 5'-X-Y-Z-3' configuration, wherein X and Z is independently 2-7 (e.g., 2, 3, 4, 5, 6, or 7) nucleosides in length and Y is 6-10 (e.g., 6, 7, 8, 9, or 10) nucleosides in length, wherein at least one but not all (e.g., 1, 2, 3, 4, 5, or 6) of positions 1, 2, 3, 4, 5, 6, or 7 in X (the 5' most position is position 1) is a non-bicyclic 2'-modified nucleoside (e.g., 2'-MOE or 2'-O-Me), wherein the rest of the nucleosides in both X and Z are 2'-4' bicyclic nucleosides (e.g., LNA or cEt), and wherein each nucleoside in Y is a 2'deoxyribonucleoside. In some embodiments, the gapmer comprises a 5'-X-Y-Z-3' configuration, wherein X and Z is independently 2-7 (e.g., 2, 3, 4, 5, 6, or 7) nucleosides in length and Y is 6-10 (e.g., 6, 7, 8, 9, or 10) nucleosides in length, wherein at least one but not all (e.g., 1, 2, 3, 4, 5, or 6) of positions 1, 2, 3, 4, 5, 6, or 7 in Z (the 5' most position is position 1) is a non-bicyclic 2'-modified nucleoside (e.g., 2'-MOE or 2'-O-Me), wherein the rest of the nucleosides in both X and Z are 2'-4' bicyclic nucleosides (e.g., LNA or cEt), and wherein each nucleoside in Y is a 2'deoxyribonucleoside. In some embodiments, the gapmer comprises a 5'-X-Y-Z-3' configuration, wherein X and Z is independently 2-7 (e.g., 2, 3, 4, 5, 6, or 7) nucleosides in length and Y is 6-10 (e.g., 6, 7, 8, 9, or 10) nucleosides in length, wherein at least one but not all (e.g., 1, 2, 3, 4, 5, or 6) of positions 1, 2, 3, 4, 5, 6, or 7 in X and at least one of positions but not all (e.g., 1, 2, 3, 4, 5, or 6) 1, 2, 3, 4, 5, 6, or 7 in Z (the 5' most position is position 1) is a non-bicyclic 2'-modified nucleoside (e.g., 2'-MOE or 2'-O-Me), wherein the rest of the nucleosides in both X and Z are 2'-4' bicyclic nucleosides (e.g., LNA or cEt), and wherein each nucleoside in Y is a 2'deoxyribonucleoside.

Non-limiting examples of gapmers configurations with a mix of non-bicyclic 2'-modified nucleoside (e.g., 2'-MOE or 2'-O-Me) and 2'-4' bicyclic nucleosides (e.g., LNA or cEt) in the 5' wing region of the gapmer (X in the 5'-X-Y-Z-3' formula) and/or the 3' wing region of the gapmer (Z in the 5'-X-Y-Z-3' formula) include: BBB-(D)n-BBBAA; KKK-(D)n-KKKAA; LLL-(D)n-LLLAA; BBB-(D)n-BBBEE; KKK-(D)n-KKKEE; LLL-(D)n-LLLEE; BBB-(D)n-BBBAA; KKK-(D)n-KKKAA; LLL-(D)n-LLLAA; BBB-(D)n-BBBEE; KKK-(D)n-KKKEE; LLL-(D)n-LLLEE; BBB-(D)n-BBBAAA; KKK-(D)n-KKKAAA; LLL-(D)n-LLLAAA; BBB-(D)n-BBBEEE; KKK-(D)n-KKKEEE; LLL-(D)n-LLLEEE; BBB-(D)n-BBBAAA; KKK-(D)n-KKKAAA; LLL-(D)n-LLLAAA; BBB-(D)n-BBBEEE; KKK-(D)n-KKKEEE; LLL-(D)n-LLLEEE; BABA-(D)n-ABAB; KAKA-(D)n-AKAK; LALA-(D)n-ALAL; BEBE-(D)n-EBEB; KEKE-(D)n-EKEK; LELE-(D)n-ELEL; BABA-(D)n-ABAB; KAKA-(D)n-AKAK; LALA-(D)n-ALAL; BEBE-(D)n-EBEB; KEKE-(D)n-EKEK; LELE-(D)n-ELEL; ABAB-(D)n-ABAB; AKAK-(D)n-AKAK; ALAL-(D)n-ALAL; EBEB-(D)n-EBEB; EKEK-(D)n-EKEK; ELEL-(D)n-ELEL; ABAB-(D)n-ABAB; AKAK-(D)n-AKAK; ALAL-(D)n-ALAL; EBEB-(D)n-EBEB; EKEK-(D)n-EKEK; ELEL-(D)n-ELEL; AABB-(D)n-BBAA; BBAA-(D)n-AABB; AAKK-(D)n-KKAA; AALL-(D)n-LLAA; EEBB-(D)n-BBEE; EEKK-(D)n-KKEE; EELL-(D)n-LLEE; AABB-(D)n-BBAA; AAKK-(D)n-KKAA; AALL-(D)n-LLAA; EEBB-(D)n-BBEE; EEKK-(D)n-KKEE; EELL-(D)n-LLEE; BBB-(D)n-BBA; KKK-(D)n-KKA; LLL-(D)n-LLA; BBB-(D)n-BBE; KKK-(D)n-KKE; LLL-(D)n-LLE; BBB-(D)n-BBA; KKK-(D)n-KKA; LLL-(D)n-LLA; BBB-(D)n-BBE; KKK-(D)n-KKE; LLL-(D)n-LLE; BBB-(D)n-BBA; KKK-(D)n-KKA; LLL-(D)n-LLA; BBB-(D)n-BBE; KKK-(D)n-KKE; LLL-(D)n-LLE; ABBB-(D)n-BBBA; AKKK-(D)n-KKKA; ALLL-(D)n-LLLA; EBBB-(D)n-BBBE; EKKK-(D)n-KKKE; ELLL-(D)n-LLLE; ABBB-(D)n-BBBA; AKKK-(D)n-KKKA; ALLL-(D)n-LLLA; EBBB-(D)n-BBBE; EKKK-(D)n-KKKE; ELLL-(D)n-LLLE; ABBB-(D)n-BBBAA; AKKK-(D)n-KKKAA; ALLL-(D)n-LLLAA; EBBB-(D)n-BBBEE; EKKK-(D)n-KKKEE; ELLL-(D)n-LLLEE; ABBB-(D)n-BBBAA; AKKK-(D)n-KKKAA; ALLL-(D)n-LLLAA; EBBB-(D)n-BBBEE; EKKK-(D)n-KKKEE; ELLL-(D)n-LLLEE; AABBB-(D)n-BBB; AAKKK-(D)n-KKK; AALLL-(D)n-LLL; EEBBB-(D)n-BBB; EEKKK-(D)n-KKK; EELLL-(D)n-LLL; AABBB-(D)n-BBB; AAKKK-(D)n-KKK; AALLL-(D)n-LLL; EEBBB-(D)n-BBB; EEKKK-(D)n-KKK; EELLL-(D)n-LLL; AABBB-(D)n-BBBA; AAKKK-(D)n-KKKA; AALLL-(D)n-LLLA; EEBBB-(D)n-BBBE; EEKKK-(D)n-KKKE; EELLL-(D)n-LLLE; AABBB-(D)n-BBBA; AAKKK-(D)n-KKKA; AALLL-(D)n-LLLA; EEBBB-(D)n-BBBE; EEKKK-(D)n-KKKE; EELLL-(D)n-LLLE; ABBAABB-(D)n-BB; AKKAAKK-(D)n-KK; ALLAALLL-(D)n-LL; EBBEEBB-(D)n-BB; EKKEEKK-(D)n-KK; ELLEELL-(D)n-LL; ABBAABB-(D)n-BB; AKKAAKK-(D)n-KK; ALLAALL-(D)n-LL; EBBEEBB-(D)n-BB; EKKEEKK-(D)n-KK; ELLEELL-(D)n-LL; ABBABB-(D)n-BBB; AKKAKK-(D)n-KKK; ALLALLL-(D)n-LLL; EBBEBB-(D)n-BBB; EKKEKK-(D)n-KKK; ELLELL-(D)n-LLL; ABBABB-(D)n-BBB; AKKAKK-(D)n-KKK; ALLALL-(D)n-LLL; EBBEBB-(D)n-BBB; EKKEKK-(D)n-KKK; ELLELL-(D)n-LLL; EEEK-(D)n-EEEEEEEE; EEK-(D)n-EEEEEEEE; EK-(D)n-EEEEEEEE; EK-(D)n-EEEKK; K-(D)n-EEEKEKE; K-(D)n-EEEKEKEE; K-(D)n-EEKEK; EK-(D)n-EEEKEKE; EK-(D)n-EEEKEK; EEK-(D)n-KEEKE; EK-(D)n-EEEKEK; EK-(D)n-KEEK; EEK-(D)n-EEEKEK; EK-(D)n-KEEE-KEE; EK-(D)n-EEKEKE; EK-(D)n-EEEKEKE; and EK-(D)n-EEEEKEK; "A" nucleosides comprise a 2'-modified nucleoside; "B" represents a 2'-4' bicyclic nucleoside; "K"

represents a constrained ethyl nucleoside (cEt); "L" represents an LNA nucleoside; and "E" represents a 2'-MOE modified ribonucleoside; "D" represents a 2'-deoxyribonucleoside; "n" represents the length of the gap segment (Y in the 5'-X-Y-Z-3' configuration) and is an integer between 1-20.

In some embodiments, any one of the gapmers described herein comprises one or more modified nucleoside linkages (e.g., a phosphorothioate linkage) in each of the X, Y, and Z regions. In some embodiments, each internucleoside linkage in the any one of the gapmers described herein is a phosphorothioate linkage. In some embodiments, each of the X, Y, and Z regions independently comprises a mix of phosphorothioate linkages and phosphodiester linkages. In some embodiments, each internucleoside linkage in the gap region Y is a phosphorothioate linkage, the 5' wing region X comprises a mix of phosphorothioate linkages and phosphodiester linkages, and the 3' wing region Z comprises a mix of phosphorothioate linkages and phosphodiester linkages.

i. Mixmers

In some embodiments, an oligonucleotide described herein may be a mixmer or comprise a mixmer sequence pattern. In general, mixmers are oligonucleotides that comprise both naturally and non-naturally occurring nucleosides or comprise two different types of non-naturally occurring nucleosides typically in an alternating pattern. Mixmers generally have higher binding affinity than unmodified oligonucleotides and may be used to specifically bind a target molecule, e.g., to block a binding site on the target molecule. Generally, mixmers do not recruit an RNase to the target molecule and thus do not promote cleavage of the target molecule. Such oligonucleotides that are incapable of recruiting RNase H have been described, for example, see WO2007/112754 or WO2007/112753.

In some embodiments, the mixmer comprises or consists of a repeating pattern of nucleoside analogues and naturally occurring nucleosides, or one type of nucleoside analogue and a second type of nucleoside analogue. However, a mixmer need not comprise a repeating pattern and may instead comprise any arrangement of modified nucleoside s and naturally occurring nucleoside s or any arrangement of one type of modified nucleoside and a second type of modified nucleoside. The repeating pattern, may, for instance be every second or every third nucleoside is a modified nucleoside, such as LNA, and the remaining nucleoside s are naturally occurring nucleosides, such as DNA, or are a 2' substituted nucleoside analogue such as 2'-MOE or 2' fluoro analogues, or any other modified nucleoside described herein. It is recognized that the repeating pattern of modified nucleoside, such as LNA units, may be combined with modified nucleoside at fixed positions—e.g. at the 5' or 3' termini.

In some embodiments, a mixmer does not comprise a region of more than 5, more than 4, more than 3, or more than 2 consecutive naturally occurring nucleosides, such as DNA nucleosides. In some embodiments, the mixmer comprises at least a region consisting of at least two consecutive modified nucleoside, such as at least two consecutive LNAs. In some embodiments, the mixmer comprises at least a region consisting of at least three consecutive modified nucleoside units, such as at least three consecutive LNAs.

In some embodiments, the mixmer does not comprise a region of more than 7, more than 6, more than 5, more than 4, more than 3, or more than 2 consecutive nucleoside analogues, such as LNAs. In some embodiments, LNA units may be replaced with other nucleoside analogues, such as those referred to herein.

Mixmers may be designed to comprise a mixture of affinity enhancing modified nucleosides, such as in non-limiting example LNA nucleosides and 2'-O-Me nucleosides. In some embodiments, a mixmer comprises modified internucleoside linkages (e.g., phosphorothioate internucleoside linkages or other linkages) between at least two, at least three, at least four, at least five or more nucleosides.

A mixmer may be produced using any suitable method. Representative U.S. patents, U.S. patent publications, and PCT publications that teach the preparation of mixmers include U.S. patent publication Nos. US20060128646, US20090209748, US20090298916, US20110077288, and US20120322851, and U.S. Pat. No. 7,687,617.

In some embodiments, a mixmer comprises one or more morpholino nucleosides. For example, in some embodiments, a mixmer may comprise morpholino nucleosides mixed (e.g., in an alternating manner) with one or more other nucleosides (e.g., DNA, RNA nucleosides) or modified nucleosides (e.g., LNA, 2'-O-Me nucleosides).

In some embodiments, mixmers are useful for splice correcting or exon skipping, for example, as reported in Touznik A., et al., *LNA/DNA mixmer-based antisense oligonucleotides correct alternative splicing of the SMN2 gene and restore SMN protein expression in type* 1 *SMA fibroblasts* Scientific Reports, volume 7, Article number: 3672 (2017), Chen S. et al., *Synthesis of a Morpholino Nucleic Acid (MNA)-Uridine Phosphoramidite, and Exon Skipping Using MNA/2'-O-Methyl Mixmer Antisense Oligonucleotide*, Molecules 2016, 21, 1582, the contents of each which are incorporated herein by reference.

j. RNA Interference (RNAi)

In some embodiments, oligonucleotides provided herein may be in the form of small interfering RNAs (siRNA), also known as short interfering RNA or silencing RNA. SiRNA, is a class of double-stranded RNA molecules, typically about 20-25 base pairs in length that target nucleic acids (e.g., mRNAs) for degradation via the RNA interference (RNAi) pathway in cells. Specificity of siRNA molecules may be determined by the binding of the antisense strand of the molecule to its target RNA. Effective siRNA molecules are generally less than 30 to 35 base pairs in length to prevent the triggering of non-specific RNA interference pathways in the cell via the interferon response, although longer siRNA can also be effective. In some embodiments, the siRNA molecules are 7, 8, 9, 10, 11, 12, 13, 14, 15, 16, 17, 18, 19, 20, 21, 22, 23, 24, 25, 26, 27, 28, 29, 30, 35, 40, 45, 50, or more base pairs in length. In some embodiments, the siRNA molecules are 8 to 30 base pairs in length, 10 to 15 base pairs in length, 10 to 20 base pairs in length, 15 to 25 base pairs in length, 19 to 21 base pairs in length, 21 to 23 base pairs in length.

Following selection of an appropriate target RNA sequence, siRNA molecules that comprise a nucleotide sequence complementary to all or a portion of the target sequence, i.e. an antisense sequence, can be designed and prepared using appropriate methods (see, e.g., PCT Publication Number WO 2004/016735; and U.S. Patent Publication Nos. 2004/0077574 and 2008/0081791). The siRNA molecule can be double stranded (i.e. a dsRNA molecule comprising an antisense strand and a complementary sense strand strand that hybridizes to form the dsRNA) or single-stranded (i.e. a ssRNA molecule comprising just an antisense strand). The siRNA molecules can comprise a duplex, asymmetric duplex, hairpin or asymmetric hairpin secondary structure, having self-complementary sense and antisense strands.

In some embodiments, the antisense strand of the siRNA molecule is 7, 8, 9, 10, 11, 12, 13, 14, 15, 16, 17, 18, 19, 20, 21, 22, 23, 24, 25, 26, 27, 28, 29, 30, 35, 40, 45, 50, or more nucleotides in length. In some embodiments, the antisense strand is 8 to 50 nucleotides in length, 8 to 40 nucleotides in length, 8 to 30 nucleotides in length, 10 to 15 nucleotides in length, 10 to 20 nucleotides in length, 15 to 25 nucleotides in length, 19 to 21 nucleotides in length, 21 to 23 nucleotides in lengths.

In some embodiments, the sense strand of the siRNA molecule is 7, 8, 9, 10, 11, 12, 13, 14, 15, 16, 17, 18, 19, 20, 21, 22, 23, 24, 25, 26, 27, 28, 29, 30, 35, 40, 45, 50, or more nucleotides in length. In some embodiments, the sense strand is 8 to 50 nucleotides in length, 8 to 40 nucleotides in length, 8 to 30 nucleotides in length, 10 to 15 nucleotides in length, 10 to 20 nucleotides in length, 15 to 25 nucleotides in length, 19 to 21 nucleotides in length, 21 to 23 nucleotides in lengths.

In some embodiments, siRNA molecules comprise an antisense strand comprising a region of complementarity to a target region in a target mRNA. In some embodiments, the region of complementarity is at least 80%, at least 85%, at least 90%, at least 91%, at least 92%, at least 93%, at least 94%, at least 95%, at least 96%, at least 97%, at least 98%, at least 99% or 100% complementary to a target region in a target mRNA. In some embodiments, the target region is a region of consecutive nucleotides in the target mRNA. In some embodiments, a complementary nucleotide sequence need not be 100% complementary to that of its target to be specifically hybridizable or specific for a target RNA sequence.

In some embodiments, siRNA molecules comprise an antisense strand that comprises a region of complementarity to a target RNA sequence and the region of complementarity is in the range of 8 to 15, 8 to 30, 8 to 40, or 10 to 50, or 5 to 50, or 5 to 40 nucleotides in length. In some embodiments, a region of complementarity is 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length. In some embodiments, the region of complementarity is complementary with at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more consecutive nucleotides of a target RNA sequence. In some embodiments, siRNA molecules comprise a nucleotide sequence that contains no more than 1, 2, 3, 4, or 5 base mismatches compared to the portion of the consecutive nucleotides of target RNA sequence. In some embodiments, siRNA molecules comprise a nucleotide sequence that has up to 3 mismatches over 15 bases, or up to 2 mismatches over 10 bases.

In some embodiments, siRNA molecules comprise an antisense strand comprising a nucleotide sequence that is complementary (e.g., at least 85%, at least 90%, at least 95%, or 100%) to the target RNA sequence of the oligonucleotides provided herein. In some embodiments, siRNA molecules comprise an antisense strand comprising a nucleotide sequence that is at least 85%, at least 90%, at least 95%, or 100% identical to the oligonucleotides provided herein. In some embodiments, siRNA molecules comprise an antisense strand comprising at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more consecutive nucleotides of the oligonucleotides provided herein.

Double-stranded siRNA may comprise sense and antisense RNA strands that are the same length or different lengths. Double-stranded siRNA molecules can also be assembled from a single oligonucleotide in a stem-loop structure, wherein self-complementary sense and antisense regions of the siRNA molecule are linked by means of a nucleic acid based or non-nucleic acid-based linker(s), as well as circular single-stranded RNA having two or more loop structures and a stem comprising self-complementary sense and antisense strands, wherein the circular RNA can be processed either in vivo or in vitro to generate an active siRNA molecule capable of mediating RNAi. Small hairpin RNA (shRNA) molecules thus are also contemplated herein. These molecules comprise a specific antisense sequence in addition to the reverse complement (sense) sequence, typically separated by a spacer or loop sequence. Cleavage of the spacer or loop provides a single-stranded RNA molecule and its reverse complement, such that they may anneal to form a dsRNA molecule (optionally with additional processing steps that may result in addition or removal of one, two, three or more nucleotides from the 3' end and/or (e.g., and) the 5' end of either or both strands). A spacer can be of a sufficient length to permit the antisense and sense sequences to anneal and form a double-stranded structure (or stem) prior to cleavage of the spacer (and, optionally, subsequent processing steps that may result in addition or removal of one, two, three, four, or more nucleotides from the 3' end and/or (e.g., and) the 5' end of either or both strands). A spacer sequence is may be an unrelated nucleotide sequence that is situated between two complementary nucleotide sequence regions which, when annealed into a double-stranded nucleic acid, comprise a shRNA.

The overall length of the siRNA molecules can vary from about 14 to about 100 nucleotides depending on the type of siRNA molecule being designed. Generally between about 14 and about 50 of these nucleotides are complementary to the RNA target sequence, i.e. constitute the specific antisense sequence of the siRNA molecule. For example, when the siRNA is a double- or single-stranded siRNA, the length can vary from about 14 to about 50 nucleotides, whereas when the siRNA is a shRNA or circular molecule, the length can vary from about 40 nucleotides to about 100 nucleotides.

An siRNA molecule may comprise a 3' overhang at one end of the molecule, The other end may be blunt-ended or have also an overhang (5' or 3'). When the siRNA molecule comprises an overhang at both ends of the molecule, the length of the overhangs may be the same or different. In one embodiment, the siRNA molecule of the present disclosure comprises 3' overhangs of about 1 to about 3 nucleotides on both ends of the molecule. In some embodiments, the siRNA molecule comprises 3' overhangs of about 1 to about 3 nucleotides on the sense strand. In some embodiments, the siRNA molecule comprises 3' overhangs of about 1 to about 3 nucleotides on the antisense strand. In some embodiments, the siRNA molecule comprises 3' overhangs of about 1 to about 3 nucleotides on both the sense strand and the antisense strand.

In some embodiments, the siRNA molecule comprises one or more modified nucleotides (e.g. 1, 2, 3, 4, 5, 6, 7, 8, 9, 10 or more). In some embodiments, the siRNA molecule comprises one or more modified nucleotides and/or (e.g., and) one or more modified internucleotide linkages. In some embodiments, the modified nucleotide is a modified sugar moiety (e.g. a 2' modified nucleotide). In some embodiments, the siRNA molecule comprises one or more 2' modified nucleotides, e.g., a 2'-deoxy, 2'-fluoro (2'-F), 2'-O-methyl (2'-O-Mc), 2'-O-methoxyethyl (2'-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA). In some embodiments, each nucleotide of the siRNA molecule is a modified nucleotide (e.g., a 2'-modified nucleotide). In some embodiments, the siRNA molecule comprises one or more phosphorodiamidate morpholinos. In some embodiments, each nucleotide of the siRNA molecule is a phosphorodiamidate morpholino.

In some embodiments, the siRNA molecule contains a phosphorothioate or other modified internucleotide linkage. In some embodiments, the siRNA molecule comprises phosphorothioate internucleoside linkages. In some embodiments, the siRNA molecule comprises phosphorothioate internucleoside linkages between at least two nucleotides. In some embodiments, the siRNA molecule comprises phosphorothioate internucleoside linkages between all nucleotides. For example, in some embodiments, the siRNA molecule comprises modified internucleotide linkages at the first, second, and/or (e.g., and) third internucleoside linkage at the 5' or 3' end of the siRNA molecule.

In some embodiments, the modified internucleotide linkages are phosphorus-containing linkages. In some embodiments, phosphorus-containing linkages that may be used include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455, 233; 5,466,677; 5,476,925; 5,519,126; 5,536,821; 5,541,306; 5,550,111; 5,563, 253; 5,571,799; 5,587,361; and 5,625,050.

Any of the modified chemistries or formats of siRNA molecules described herein can be combined with each other. For example, one, two, three, four, five, or more different types of modifications can be included within the same siRNA molecule.

In some embodiments, the antisense strand comprises one or more modified nucleotides (e.g. 1, 2, 3, 4, 5, 6, 7, 8, 9, 10 or more). In some embodiments, the antisense strand comprises one or more modified nucleotides and/or (e.g., and) one or more modified internucleotide linkages. In some embodiments, the modified nucleotide comprises a modified sugar moiety (e.g. a 2' modified nucleotide). In some embodiments, the antisense strand comprises one or more 2' modified nucleotides, e.g., a 2'-deoxy, 2'-fluoro (2'-F), 2'-O-methyl (2'-O-Mc), 2'-O-methoxyethyl (2'-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA). In some embodiments, each nucleotide of the antisense strand is a modified nucleotide (e.g., a 2'-modified nucleotide). In some embodiments, the antisense strand comprises one or more phosphorodiamidate morpholinos. In some embodiments, the antisense strand is a phosphorodiamidate morpholino oligomer (PMO).

In some embodiments, antisense strand contains a phosphorothioate or other modified internucleotide linkage. In some embodiments, the antisense strand comprises phosphorothioate internucleoside linkages. In some embodiments, the antisense strand comprises phosphorothioate internucleoside linkages between at least two nucleotides. In some embodiments, the antisense strand comprises phosphorothioate internucleoside linkages between all nucleotides. For example, in some embodiments, the antisense strand comprises modified internucleotide linkages at the first, second, and/or (e.g., and) third internucleoside linkage at the 5' or 3' end of the siRNA molecule. In some embodiments, the modified internucleotide linkages are phosphorus-containing linkages. In some embodiments, phosphorus-containing linkages that may be used include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455, 233; 5,466,677; 5,476,925; 5,519,126; 5,536,821; 5,541,306; 5,550,111; 5,563, 253; 5,571,799; 5,587,361; and 5,625,050.

Any of the modified chemistries or formats of the antisense strand described herein can be combined with each other. For example, one, two, three, four, five, or more different types of modifications can be included within the same antisense strand.

In some embodiments, the sense strand comprises one or more modified nucleotides (e.g. 1, 2, 3, 4, 5, 6, 7, 8, 9, 10 or more). In some embodiments, the sense strand comprises one or more modified nucleotides and/or (e.g., and) one or more modified internucleotide linkages. In some embodiments, the modified nucleotide is a modified sugar moiety (e.g. a 2' modified nucleotide). In some embodiments, the sense strand comprises one or more 2' modified nucleotides, e.g., a 2'-deoxy, 2'-fluoro (2'-F), 2'-O-methyl (2'-O-Mc), 2'-O-methoxyethyl (2'-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA). In some embodiments, each nucleotide of the sense strand is a modified nucleotide (e.g., a 2'-modified nucleotide). In some embodiments, the sense strand comprises one or more phosphorodiamidate morpholinos. In some embodiments, the antisense strand is a phosphorodiamidate morpholino oligomer (PMO). In some embodiments, the sense strand contains a phosphorothioate or other modified internucleotide linkage. In some embodiments, the sense strand comprises phosphorothioate internucleoside linkages. In some embodiments, the sense strand comprises phosphorothioate internucleoside linkages between at least two nucleotides. In some embodiments, the sense strand comprises phosphorothioate internucleoside linkages between all nucleotides. For example, in some embodiments, the sense strand comprises modified internucleotide linkages at the first, second, and/or (e.g., and) third internucleoside linkage at the 5' or 3' end of the sense strand.

In some embodiments, the modified internucleotide linkages are phosphorus-containing linkages. In some embodiments, phosphorus-containing linkages that may be used include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455, 233; 5,466,677; 5,476,925; 5,519,126; 5,536,821; 5,541,306; 5,550, 111; 5,563, 253; 5,571,799; 5,587,361; and 5,625,050.

Any of the modified chemistries or formats of the sense strand described herein can be combined with each other. For example, one, two, three, four, five, or more different types of modifications can be included within the same sense strand.

In some embodiments, the antisense or sense strand of the siRNA molecule comprises modifications that enhance or reduce RNA-induced silencing complex (RISC) loading. In some embodiments, the antisense strand of the siRNA molecule comprises modifications that enhance RISC loading. In some embodiments, the sense strand of the siRNA molecule comprises modifications that reduce RISC loading and reduce off-target effects. In some embodiments, the antisense strand of the siRNA molecule comprises a 2'-O-methoxyethyl (2'-MOE) modification. The addition of the 2'-O-methoxyethyl (2'-MOE) group at the cleavage site improves both the specificity and silencing activity of siRNAs by facilitating the oriented RNA-induced silencing complex (RISC) loading of the modified strand, as described in Song et al., (2017) Mol Ther Nucleic Acids 9:242-250, incorporated herein by reference in its entirety. In some embodiments, the antisense strand of the siRNA molecule comprises a 2'-OMe-phosphorodithioate modification, which increases RISC loading as described in Wu et al., (2014) Nat Commun 5:3459, incorporated herein by reference in its entirety.

In some embodiments, the sense strand of the siRNA molecule comprises a 5'-morpholino, which reduces RISC loading of the sense strand and improves antisense strand selection and RNAi activity, as described in Kumar et al., (2019) Chem Commun (Camb) 55 (35): 5139-5142, incorporated herein by reference in its entirety. In some embodiments, the sense strand of the siRNA molecule is modified with a synthetic RNA-like high affinity nucleotide analogue, Locked Nucleic Acid (LNA), which reduces RISC loading of the sense strand and further enhances antisense strand incorporation into RISC, as described in Elman et al., (2005) Nucleic Acids Res. 33 (1): 439-447, incorporated herein by reference in its entirety.

In some embodiments, the sense strand of the siRNA molecule comprises a 5' unlocked nucleic acid (UNA) modification, which reduce RISC loading of the sense strand and improve silencing potency of the antisense strand, as described in Snead et al., (2013) Mol Ther Nucleic Acids 2 (7): e103, incorporated herein by reference in its entirety. In some embodiments, the sense strand of the siRNA molecule comprises a 5-nitroindole modification, which decreased the RNAi potency of the sense strand and reduces off-target effects as described in Zhang et al., (2012) Chembiochem 13 (13): 1940-1945, incorporated herein by reference in its entirety. In some embodiments, the sense strand comprises a 2'-O'methyl (2'-O-Me) modification, which reduces RISC loading and the off-target effects of the sense strand, as described in Zheng et al., FASEB (2013) 27 (10): 4017-4026, incorporated herein by reference in its entirety. In some embodiments, the sense strand of the siRNA molecule is fully substituted with morpholino, 2'-MOE or 2'-O-Me residues, and are not recognized by RISC as described in Kole et al., (2012) Nature reviews. Drug Discovery 11 (2): 125-140, incorporated herein by reference in its entirety. In some embodiments the antisense strand of the siRNA molecule comprises a 2'-MOE modification and the sense strand comprises an 2'-O-Me modification (see e.g., Song et al., (2017) Mol Ther Nucleic Acids 9:242-250). In some embodiments at least one (e.g., at least 2, at least 3, at least 4, at least 5, at least 10) siRNA molecule is linked (e.g., covalently) to a muscle-targeting agent. In some embodiments, the muscle-targeting agent may comprise, or consist of, a nucleic acid (e.g., DNA or RNA), a peptide (e.g., an antibody), a lipid (e.g., a microvesicle), or a sugar moiety (e.g., a polysaccharide). In some embodiments, the muscle-targeting agent is an antibody. In some embodiments, the muscle-targeting agent is an anti-transferrin receptor antibody (e.g., any one of the anti-TfR antibodies provided herein). In some embodiments, the muscle-targeting agent may be linked to the 5' end of the sense strand of the siRNA molecule. In some embodiments, the muscle-targeting agent may be linked to the 3' end of the sense strand of the siRNA molecule. In some embodiments, the muscle-targeting agent may be linked internally to the sense strand of the siRNA molecule. In some embodiments, the muscle-targeting agent may be linked to the 5' end of the antisense strand of the siRNA molecule. In some embodiments, the muscle-targeting agent may be linked to the 3' end of the antisense strand of the siRNA molecule. In some embodiments, the muscle-targeting agent may be linked internally to the antisense strand of the siRNA molecule.

k. MicroRNA (miRNAs)

In some embodiments, an oligonucleotide may be a microRNA (miRNA). MicroRNAs (referred to as "miRNAs") are small non-coding RNAs, belonging to a class of regulatory molecules that control gene expression by binding to complementary sites on a target RNA transcript. Typically, miRNAs are generated from large RNA precursors (termed pri-miRNAs) that are processed in the nucleus into approximately 70 nucleotide pre-miRNAs, which fold into imperfect stem-loop structures. These pre-miRNAs typically undergo an additional processing step within the cytoplasm where mature miRNAs of 18-25 nucleotides in length are excised from one side of the pre-miRNA hairpin by an RNase III enzyme, Dicer.

As used herein, miRNAs including pri-miRNA, pre-miRNA, mature miRNA or fragments of variants thereof that retain the biological activity of mature miRNA. In one embodiment, the size range of the miRNA can be from 21 nucleotides to 170 nucleotides. In one embodiment the size range of the miRNA is from 70 to 170 nucleotides in length. In another embodiment, mature miRNAs of from 21 to 25 nucleotides in length can be used.

1. Aptamers

In some embodiments, oligonucleotides provided herein may be in the form of aptamers. Generally, in the context of molecular payloads, aptamer is any nucleic acid that binds specifically to a target, such as a small molecule, protein, nucleic acid in a cell. In some embodiments, the aptamer is a DNA aptamer or an RNA aptamer. In some embodiments, a nucleic acid aptamer is a single-stranded DNA or RNA (ssDNA or ssRNA). It is to be understood that a single-stranded nucleic acid aptamer may form helices and/or (e.g., and) loop structures. The nucleic acid that forms the nucleic acid aptamer may comprise naturally occurring nucleotides, modified nucleotides, naturally occurring nucleotides with hydrocarbon linkers (e.g., an alkylene) or a polyether linker (e.g., a PEG linker) inserted between one or more nucleotides, modified nucleotides with hydrocarbon or PEG linkers inserted between one or more nucleotides, or a combination of thereof. Exemplary publications and patents describing aptamers and method of producing aptamers include, e.g., Lorsch and Szostak, 1996; Jayasena, 1999; U.S. Pat. Nos. 5,270,163; 5,567,588; 5,650,275; 5,670,637; 5,683,867; 5,696,249; 5,789,157; 5,843,653; 5,864,026; 5,989,823; 6,569,630; 8,318,438 and PCT application WO 99/31275, each incorporated herein by reference.

m. Ribozymes

In some embodiments, oligonucleotides provided herein may be in the form of a ribozyme. A ribozyme (ribonucleic acid enzyme) is a molecule, typically an RNA molecule, that is capable of performing specific biochemical reactions, similar to the action of protein enzymes. Ribozymes are molecules with catalytic activities including the ability to cleave at specific phosphodiester linkages in RNA molecules to which they have hybridized, such as mRNAs, RNA-containing substrates, lncRNAs, and ribozymes, themselves.

Ribozymes may assume one of several physical structures, one of which is called a "hammerhead." A hammerhead ribozyme is composed of a catalytic core containing nine conserved bases, a double-stranded stem and loop structure (stem-loop II), and two regions complementary to the target RNA flanking regions the catalytic core. The flanking regions enable the ribozyme to bind to the target RNA specifically by forming double-stranded stems I and III. Cleavage occurs in cis (i.e., cleavage of the same RNA molecule that contains the hammerhead motif) or in trans (cleavage of an RNA substrate other than that containing the ribozyme) next to a specific ribonucleotide triplet by a transesterification reaction from a 3', 5'-phosphate diester to a 2', 3'-cyclic phosphate diester. Without wishing to be bound by theory, it is believed that this catalytic activity requires the presence of specific, highly conserved sequences in the catalytic region of the ribozyme.

Modifications in ribozyme structure have also included the substitution or replacement of various non-core portions of the molecule with non-nucleotidic molecules. For example, Benseler et al. (J. Am. Chem. Soc. (1993) 115: 8483-8484) disclosed hammerhead-like molecules in which two of the base pairs of stem II, and all four of the nucleotides of loop II were replaced with non-nucleoside linkers based on hexaethylene glycol, propanediol, bis(tri-ethylene glycol) phosphate, tris (propanediol) bisphosphate, or bis (propanediol) phosphate. Ma et al. (Biochem. (1993) 32:1751-1758; Nucleic Acids Res. (1993) 21:2585-2589) replaced the six nucleotide loop of the TAR ribozyme hairpin with non-nucleotidic, ethylene glycol-related linkers. Thomson et al. (Nucleic Acids Res. (1993) 21:5600-5603) replaced loop II with linear, non-nucleotidic linkers of 13, 17, and 19 atoms in length.

Ribozyme oligonucleotides can be prepared using well known methods (see, e.g., PCT Publications WO9118624; WO9413688; WO9201806; and WO 92/07065; and U.S. Pat. Nos. 5,436,143 and 5,650,502) or can be purchased from commercial sources (e.g., US Biochemicals) and, if desired, can incorporate nucleotide analogs to increase the resistance of the oligonucleotide to degradation by nucleases in a cell. The ribozyme may be synthesized in any known manner, e.g., by use of a commercially available synthesizer produced, e.g., by Applied Biosystems, Inc. or Milligen. The ribozyme may also be produced in recombinant vectors by conventional means. Sec, Molecular Cloning: A Laboratory Manual, Cold Spring Harbor Laboratory (Current edition). The ribozyme RNA sequences may be synthesized conventionally, for example, by using RNA polymerases such as T7 or SP6.

n. Guide Nucleic Acids

In some embodiments, oligonucleotides are guide nucleic acid, e.g., guide RNA (gRNA) molecules. Generally, a guide RNA is a short synthetic RNA composed of (1) a scaffold sequence that binds to a nucleic acid programmable DNA binding protein (napDNAbp), such as Cas9, and (2) a nucleotide spacer portion that defines the DNA target sequence (e.g., genomic DNA target) to which the gRNA binds in order to bring the nucleic acid programmable DNA binding protein in proximity to the DNA target sequence. In some embodiments, the napDNAbp is a nucleic acid-programmable protein that forms a complex with (e.g., binds or associates with) one or more RNA(s) that targets the nucleic acid-programmable protein to a target DNA sequence (e.g., a target genomic DNA sequence). In some embodiments, a nucleic acid-programmable nuclease, when in a complex with an RNA, may be referred to as a nuclease: RNA complex. Guide RNAs can exist as a complex of two or more RNAs, or as a single RNA molecule.

Guide RNAs (gRNAs) that exist as a single RNA molecule may be referred to as single-guide RNAs (sgRNAs), though gRNA is also used to refer to guide RNAs that exist as either single molecules or as a complex of two or more molecules. Typically, gRNAs that exist as a single RNA species comprise two domains: (1) a domain that shares homology to a target nucleic acid (i.e., directs binding of a Cas9 complex to the target); and (2) a domain that binds a Cas9 protein. In some embodiments, domain (2) corresponds to a sequence known as a tracrRNA and comprises a stem-loop structure. In some embodiments, domain (2) is identical or homologous to a tracrRNA as provided in Jinek et al., Science 337:816-821 (2012), the entire contents of which is incorporated herein by reference.

In some embodiments, a gRNA comprises two or more of domains (1) and (2), and may be referred to as an extended gRNA. For example, an extended gRNA will bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease: RNA complex. In some embodiments, the RNA-programmable nuclease is the (CRISPR-associated system) Cas9 endonuclease, for example, Cas9 (Csn1) from *Streptococcus pyogenes* (see, e.g., "Complete genome sequence of an MI strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roc B. A., McLaughlin R. E., Proc. Natl. Acad. Sci. U.S.A. 98:4658-

4663 (2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607 (2011); and "A programmable dual-RNA-guided DNA endonuclease in adaptive bacterial immunity." Jinek M., Chylinski K., Fonfara I., Hauer M., Doudna J. A., Charpentier E. Science 337:816-821 (2012), the entire contents of each of which are incorporated herein by reference.

o. Multimers

In some embodiments, molecular payloads may comprise multimers (e.g., concatemers) of 2 or more oligonucleotides connected by a linker. In this way, in some embodiments, the oligonucleotide loading of a complex can be increased beyond the available linking sites on a targeting agent (e.g., available thiol sites on an antibody) or otherwise tuned to achieve a particular payload loading content. Oligonucleotides in a multimer can be the same or different (e.g., targeting different genes or different sites on the same gene or products thereof).

In some embodiments, multimers comprise 2 or more oligonucleotides linked together by a cleavable linker. However, in some embodiments, multimers comprise 2 or more oligonucleotides linked together by a non-cleavable linker. In some embodiments, a multimer comprises 2, 3, 4, 5, 6, 7, 8, 9, 10 or more oligonucleotides linked together. In some embodiments, a multimer comprises 2 to 5, 2 to 10 or 4 to 20 oligonucleotides linked together.

In some embodiments, a multimer comprises 2 or more oligonucleotides linked end-to-end (in a linear arrangement). In some embodiments, a multimer comprises 2 or more oligonucleotides linked end-to-end via a oligonucleotide based linker (e.g., poly-dT linker, an abasic linker). In some embodiments, a multimer comprises a 5' end of one oligonucleotide linked to a 3' end of another oligonucleotide. In some embodiments, a multimer comprises a 3' end of one oligonucleotide linked to a 3' end of another oligonucleotide. In some embodiments, a multimer comprises a 5' end of one oligonucleotide linked to a 5' end of another oligonucleotide. Still, in some embodiments, multimers can comprise a branched structure comprising multiple oligonucleotides linked together by a branching linker.

Further examples of multimers that may be used in the complexes provided herein are disclosed, for example, in US Patent Application Number 2015/0315588 A1, entitled Methods of delivering multiple targeting oligonucleotides to a cell using cleavable linkers, which was published on Nov. 5, 2015; US Patent Application Number 2015/0247141 A1, entitled Multimeric Oligonucleotide Compounds, which was published on Sep. 3, 2015, US Patent Application Number US 2011/0158937 A1, entitled Immunostimulatory Oligonucleotide Multimers, which was published on Jun. 30, 2011; and U.S. Pat. No. 5,693,773, entitled Triplex-Forming Antisense Oligonucleotides Having Abasic Linkers Targeting Nucleic Acids Comprising Mixed Sequences Of Purines And Pyrimidines, which issued on Dec. 2, 1997, the contents of each of which are incorporated herein by reference in their entireties.

ii. Small Molecules:

Any suitable small molecule may be used as a molecular payload, as described herein. In some embodiments, the small molecule enhances exon skipping of DMD mutant sequences. In some embodiments, the small molecule is as described in US Patent Application Publication US20140080896A1, published Mar. 20, 2014, entitled "IDENTIFICATION OF SMALL MOLECULES THAT FACILITATE THERAPEUTIC EXON SKIPPING". Further examples of small molecule payloads are provided in U.S. Pat. No. 9,982,260, issued May 29, 2018, entitled "Identification of structurally similar small molecules that enhance therapeutic exon skipping". For example, in some embodiments, the small molecule is an enhancer of exon skipping such as perphenazine, flupentixol, zuclopenthixol or corynanthine. In some embodiments, a small molecule enhancer of exon skipping inhibits the ryanodine receptor or calmodulin. In some embodiments, the small molecule is an H-Ras pathway inhibitor such as manumycin A. In some embodiments, the small molecule is a suppressor of stop codons and desensitizes ribosomes to premature stop codons. In some embodiments, the small molecule is ataluren, as described in McElroy S. P. et al. "A Lack of Premature Termination Codon Read Through Efficacy of PTC124 (Ataluren) in a Diverse Array of Reporter Assays." PLOS Biology, published Jun. 25, 2013. In some embodiments, the small molecule is a corticosteroid, e.g., as described in Manzur, A. Y. et al. "Glucocorticoid corticosteroids for Duchenne muscular dystrophy". Cochrane Database Syst Rev. 2004; (2): CD003725. In some embodiments, the small molecule upregulates the expression and/or (e.g., and) activity of genes that can replace the function of dystrophin, such as utrophin. In some embodiments, a utrophin modulator is as described in International Publication No. WO2007091106, published Aug. 16, 2007, entitled "TREATMENT OF DUCHENNE MUSCULAR DYSTROPHY" and/or (e.g., and) International Publication No. WO/2017/168151, published Oct. 5, 2017, entitled "COMPOSITION FOR THE TREATMENT OF DUCHENNE MUSCULAR DYSTROPHY".

iii. Peptides/Proteins

Any suitable peptide or protein may be used as a molecular payload, as described herein. In some embodiments, a protein is an enzyme. In some embodiments, peptides or proteins may be produced, synthesized, and/or (e.g., and) derivatized using several methodologies, e.g. phage displayed peptide libraries, one-bead one-compound peptide libraries, or positional scanning synthetic peptide combinatorial libraries. Exemplary methodologies have been characterized in the art and are incorporated by reference (Gray, B. P. and Brown, K. C. "Combinatorial Peptide Libraries: Mining for Cell-Binding Peptides" Chem Rev. 2014, 114:2, 1020-1081.; Samoylova, T. I. and Smith, B. F. "Elucidation of muscle-binding peptides by phage display screening." Muscle Nerve, 1999, 22:4. 460-6.).

In some embodiments, a peptide may facilitate exon skipping in an mRNA expressed from a mutated DMD allele. In some embodiments, a peptide may promote the expression of functional dystrophin and/or (e.g., and) the expression of a protein capable of functioning in place of dystrophin. In some embodiments, payload is a protein that is a functional fragment of dystrophin, e.g. an amino acid segment of a functional dystrophin protein.

In some embodiments, the peptide or protein comprises at least one zinc finger.

In some embodiments, the peptide or protein may comprise about 2-25 amino acids, about 2-20 amino acids, about 2-15 amino acids, about 2-10 amino acids, or about 2-5 amino acids. The peptide or protein may comprise naturally-occurring amino acids, e.g. cysteine, alanine, or non-naturally-occurring or modified amino acids. Non-naturally occurring amino acids include β-amino acids, homo-amino acids, proline derivatives, 3-substituted alanine derivatives, linear core amino acids, N-methyl amino acids, and others known in the art. In some embodiments, the peptide may be linear; in other embodiments, the peptide may be cyclic, e.g. bicyclic.

iv. Nucleic Acid Constructs

Any suitable gene expression construct may be used as a molecular payload, as described herein. In some embodiments, a gene expression construct may be a vector or a cDNA fragment. In some embodiments, a gene expression construct may be messenger RNA (mRNA). In some embodiments, a mRNA used herein may be a modified mRNA, e.g., as described in U.S. Pat. No. 8,710,200, issued on Apr. 24, 2014, entitled "Engineered nucleic acids encoding a modified erythropoietin and their expression". In some embodiments, a mRNA may comprise a 5' methyl cap. In some embodiments, a mRNA may comprise a polyA tail, optionally of up to 160 nucleotides in length. A gene expression construct may encode a sequence of a dystrophin protein, a dystrophin fragment, a mini-dystrophin, a utrophin protein, or any protein that shares a common function with dystrophin. In some embodiments, the gene expression construct may be expressed, e.g., overexpressed, within the nucleus of a muscle cell. In some embodiments, the gene expression constructs encodes a protein that comprises at least one zinc finger. In some embodiments, the gene expression construct encodes a protein that promotes the expression of dystrophin or a protein that shares function with dystrophin, e.g., utrophin. In some embodiments, the gene expression construct encodes a gene editing enzyme. In some embodiments, the gene expression construct is as described in U.S. Patent Application Publication US20170368198A1, published Dec. 28, 2017, entitled "Optimized mini-dystrophin genes and expression cassettes and their use"; Duan D. "Myodys, a full-length dystrophin plasmid vector for Duchenne and Becker muscular dystrophy gene therapy." Curr Opin Mol Ther 2008; 10:86-94; and expression cassettes disclosed in Tang, Y. et al., "AAV-directed muscular dystrophy gene therapy" Expert Opin Biol Ther. 2010 March; 10 (3): 395-408; the contents of each of which are incorporated herein by reference in their entireties.

C. Linkers

Complexes described herein generally comprise a linker that connects any one of the anti-TfR antibodies described herein to a molecular payload. A linker comprises at least one covalent bond. In some embodiments, a linker may be a single bond, e.g., a disulfide bond or disulfide bridge, that connects an anti-TfR antibody to a molecular payload. However, in some embodiments, a linker may connect any one of the anti-TfR antibodies described herein to a molecular payload through multiple covalent bonds. In some embodiments, a linker may be a cleavable linker. However, in some embodiments, a linker may be a non-cleavable linker. A linker is generally stable in vitro and in vivo, and may be stable in certain cellular environments. Additionally, generally a linker does not negatively impact the functional properties of either the anti-TfR antibody or the molecular payload. Examples and methods of synthesis of linkers are known in the art (see, e.g. Kline, T. et al. "Methods to Make Homogenous Antibody Drug Conjugates." Pharmaceutical Research, 2015, 32:11, 3480-3493.; Jain, N. et al. "Current ADC Linker Chemistry" Pharm Res. 2015, 32:11, 3526-3540.; McCombs, J. R. and Owen, S. C. "Antibody Drug Conjugates: Design and Selection of Linker, Payload and Conjugation Chemistry" AAPS J. 2015, 17:2, 339-351.).

A precursor to a linker typically will contain two different reactive species that allow for attachment to both the anti-TfR antibody and a molecular payload. In some embodiments, the two different reactive species may be a nucleophile and/or (e.g., and) an electrophile. In some embodiments, a linker is connected to an anti-TfR antibody via conjugation to a lysine residue or a cysteine residue of the anti-TfR antibody. In some embodiments, a linker is connected to a cysteine residue of an anti-TfR antibody via a maleimide-containing linker, wherein optionally the maleimide-containing linker comprises a maleimidocaproyl or maleimidomethyl cyclohexane-1-carboxylate group. In some embodiments, a linker is connected to a cysteine residue of an anti-TfR antibody or thiol functionalized molecular payload via a 3-arylpropionitrile functional group. In some embodiments, a linker is connected to a lysine residue of an anti-TfR antibody. In some embodiments, a linker is connected to an anti-TfR antibody and/or (e.g., and) a molecular payload via an amide bond, a carbamate bond, a hydrazide, a trizaole, a thioether, or a disulfide bond.

i. Cleavable Linkers

A cleavable linker may be a protease-sensitive linker, a pH-sensitive linker, or a glutathione-sensitive linker. These linkers are generally cleavable only intracellularly and are preferably stable in extracellular environments, e.g. extracellular to a muscle cell.

Protease-sensitive linkers are cleavable by protease enzymatic activity. These linkers typically comprise peptide sequences and may be 2-10 amino acids, about 2-5 amino acids, about 5-10 amino acids, about 10 amino acids, about 5 amino acids, about 3 amino acids, or about 2 amino acids in length. In some embodiments, a peptide sequence may comprise naturally-occurring amino acids, e.g. cysteine, alanine, or non-naturally-occurring or modified amino acids. Non-naturally occurring amino acids include β-amino acids, homo-amino acids, proline derivatives, 3-substituted alanine derivatives, linear core amino acids, N-methyl amino acids, and others known in the art. In some embodiments, a protease-sensitive linker comprises a valine-citrulline or alanine-citrulline dipeptide sequence. In some embodiments, a protease-sensitive linker can be cleaved by a lysosomal protease, e.g. cathepsin B, and/or (e.g., and) an endosomal protease.

A pH-sensitive linker is a covalent linkage that readily degrades in high or low pH environments. In some embodiments, a pH-sensitive linker may be cleaved at a pH in a range of 4 to 6. In some embodiments, a pH-sensitive linker comprises a hydrazone or cyclic acetal. In some embodiments, a pH-sensitive linker is cleaved within an endosome or a lysosome.

In some embodiments, a glutathione-sensitive linker comprises a disulfide moiety. In some embodiments, a glutathione-sensitive linker is cleaved by a disulfide exchange reaction with a glutathione species inside a cell. In some embodiments, the disulfide moiety further comprises at least one amino acid, e.g. a cysteine residue.

In some embodiments, the linker is a Val-cit linker (e.g., as described in U.S. Pat. No. 6,214,345, incorporated herein by reference). In some embodiments, before conjugation, the val-cit linker has a structure of:

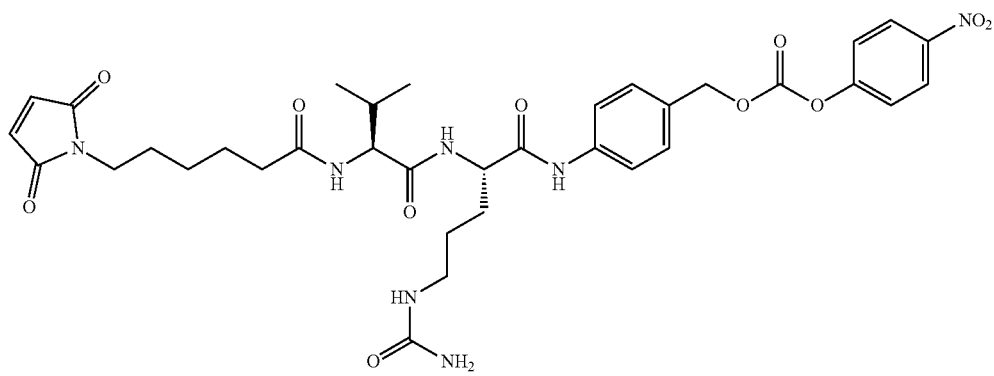 [SMILES: CC(C)[C@H](NC(=O)CCCCCN1C(=O)C=CC1=O)C(=O)N[C@@H](CCCNC(N)=O)C(=O)Nc1ccc(COC(=O)Oc2ccc([N+](=O)[O-])cc2)cc1]

In some embodiments, after conjugation, the val-cit linker has a structure of:

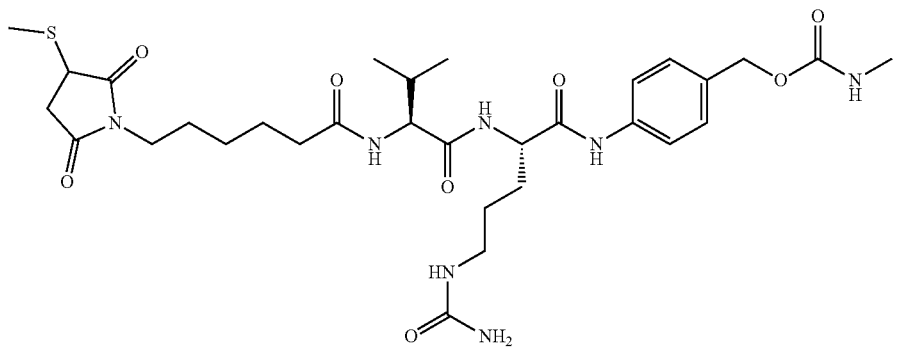

In some embodiments, the Val-cit linker is attached to a reactive chemical moiety (e.g., SPAAC for click chemistry conjugation). In some embodiments, before click chemistry conjugation, the val-cit linker attached to a reactive chemical moiety (e.g., SPAAC for click chemistry conjugation) has the structure of:

In some embodiments, the val-cit linker attached to a reactive chemical moiety (e.g., SPAAC for click chemistry conjugation) is conjugated (e.g., via a different chemical moiety) to a molecular payload (e.g., an oligonucleotide). In some embodiments, the val-cit linker attached to a reactive chemical moiety (e.g., SPAAC for click chemistry conjugation) and conjugated to a molecular payload (e.g., an oligo-

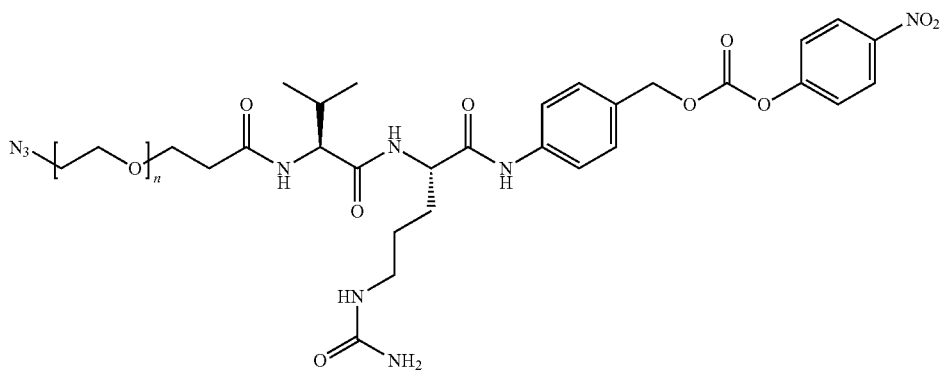

wherein n is any number from 0-10. In some embodiments, n is 3.

nucleotide) has the structure of (before click chemistry conjugation):

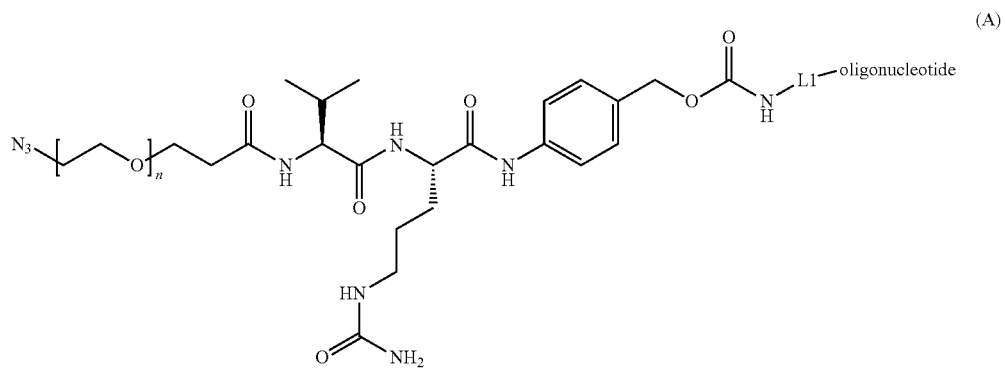

(A)

wherein n is any number from 0-10. In some embodiments, n is 3.

In some embodiments, after conjugation to a molecular payload (e.g., an oligonucleotide), the val-cit linker has a structure of:

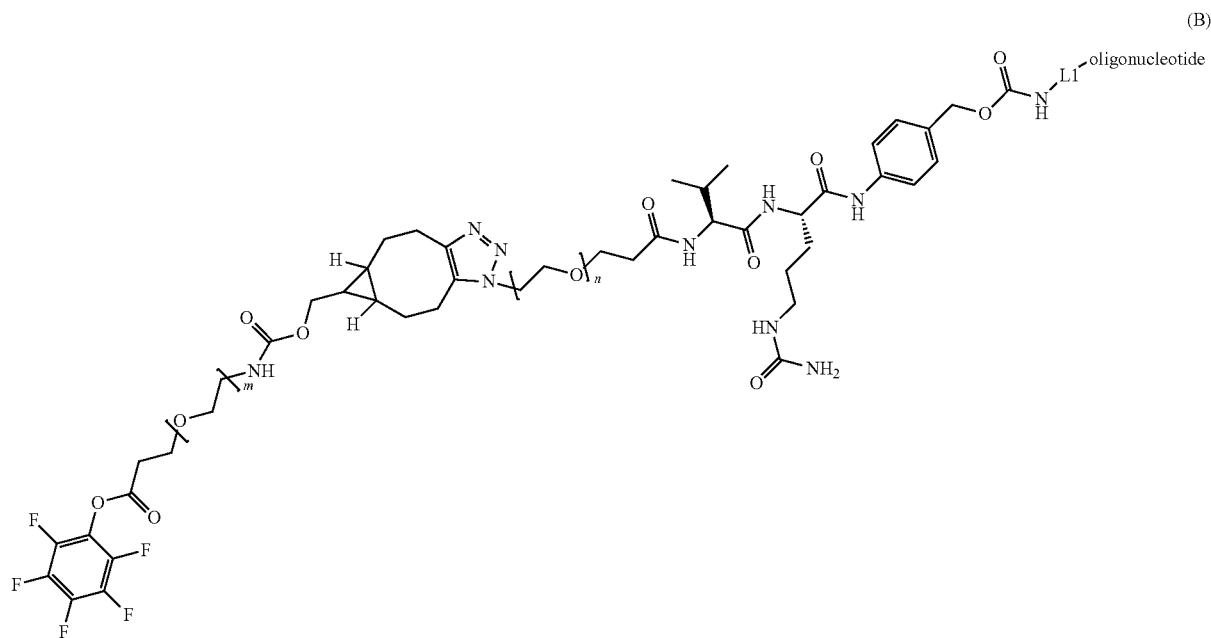

(B)

wherein n is any number from 0-10, and wherein m is any number from 0-10. In some embodiments, n is 3 and m is 4.

ii. Non-Cleavable Linkers

In some embodiments, non-cleavable linkers may be used. Generally, a non-cleavable linker cannot be readily degraded in a cellular or physiological environment. In some embodiments, a non-cleavable linker comprises an optionally substituted alkyl group, wherein the substitutions may include halogens, hydroxyl groups, oxygen species, and other common substitutions. In some embodiments, a linker may comprise an optionally substituted alkyl, an optionally substituted alkylene, an optionally substituted arylene, a heteroarylene, a peptide sequence comprising at least one non-natural amino acid, a truncated glycan, a sugar or sugars that cannot be enzymatically degraded, an azide, an alkyne-azide, a peptide sequence comprising a LPXT sequence, a thioether, a biotin, a biphenyl, repeating units of polyethylene glycol or equivalent compounds, acid esters, acid amides, sulfamides, and/or (e.g., and) an alkoxy-amine linker. In some embodiments, sortase-mediated ligation will be utilized to covalently link an anti-TfR antibody comprising a LPXT sequence to a molecular payload comprising a (G), sequence (see, e.g. Proft T. Sortase-mediated protein ligation: an emerging biotechnology tool for protein modification and immobilization. Biotechnol Lett. 2010, 32 (1): 1-10.).

In some embodiments, a linker may comprise a substituted alkylene, an optionally substituted alkenylene, an optionally substituted alkynylene, an optionally substituted cycloalkylene, an optionally substituted cycloalkenylene, an optionally substituted arylene, an optionally substituted heteroarylene further comprising at least one heteroatom selected from N, O, and S; an optionally substituted heterocyclylene further comprising at least one heteroatom selected from N, O, and S; an imino, an optionally substituted nitrogen species, an optionally substituted oxygen species O, an optionally substituted sulfur species, or a poly (alkylene oxide), e.g. polyethylene oxide or polypropylene oxide.

iii. Linker Conjugation

In some embodiments, a linker is connected to an anti-TfR antibody and/or (e.g., and) molecular payload via a phosphate, thioether, ether, carbon-carbon, carbamate, or amide bond. In some embodiments, a linker is connected to an oligonucleotide through a phosphate or phosphorothioate group, e.g. a terminal phosphate of an oligonucleotide backbone. In some embodiments, a linker is connected to an anti-TfR antibody, through a lysine or cysteine residue present on the anti-TfR antibody.

In some embodiments, a linker is connected to an anti-TfR antibody and/or (e.g., and) molecular payload by a cycloaddition reaction between an azide and an alkyne to form a triazole, wherein the azide and the alkyne may be located on the anti-TfR antibody, molecular payload, or the linker. In some embodiments, an alkyne may be a cyclic alkyne, e.g., a cyclooctyne. In some embodiments, an alkyne may be bicyclononyne (also known as bicyclo[6.1.0]nonyne or BCN) or substituted bicyclononyne. In some embodiments, a cyclooctane is as described in International Patent Application Publication WO2011136645, published on Nov. 3, 2011, entitled, "Fused Cyclooctyne Compounds And Their Use In Metal-free Click Reactions". In some embodiments, an azide may be a sugar or carbohydrate molecule that comprises an azide. In some embodiments, an azide may be 6-azido-6-deoxygalactose or 6-azido-N-acetylgalactosamine. In some embodiments, a sugar or carbohydrate molecule that comprises an azide is as described in International Patent Application Publication WO2016170186, published on Oct. 27, 2016, entitled, "Process For The Modification Of A Glycoprotein Using A Glycosyltransferase That Is Or Is Derived From A β(1,4)-N-Acetylgalactosaminyltransferase". In some embodiments, a cycloaddition reaction between an azide and an alkyne to form a triazole, wherein the azide and the alkyne may be located on the anti-TfR antibody, molecular payload, or the linker is as described in International Patent Application Publication WO2014065661, published on May 1, 2014, entitled, "Modified antibody, antibody-conjugate and process for the preparation thereof"; or International Patent Application Publication WO2016170186, published on Oct. 27, 2016, entitled, "Process For The Modification Of A Glycoprotein Using A Glycosyltransferase That Is Or Is Derived From A β(1,4)-N-Acetylgalactosaminyltransferase".

In some embodiments, a linker further comprises a spacer, e.g., a polyethylene glycol spacer or an acyl/carbomoyl sulfamide spacer, e.g., a HydraSpace™ spacer. In some embodiments, a spacer is as described in Verkade, J. M. M. et al., "*A Polar Sulfamide Spacer Significantly Enhances the Manufacturability, Stability, and Therapeutic Index of Antibody-Drug Conjugates*", Antibodies, 2018, 7, 12.

In some embodiments, a linker is connected to an anti-TfR antibody and/or (e.g., and) molecular payload by the Diels-Alder reaction between a dienophile and a diene/hetero-diene, wherein the dienophile and the diene/hetero-diene may be located on the anti-TfR antibody, molecular payload, or the linker. In some embodiments a linker is connected to an anti-TfR antibody and/or (e.g., and) molecular payload by other pericyclic reactions, e.g. ene reaction. In some embodiments, a linker is connected to an anti-TfR antibody and/or (e.g., and) molecular payload by an amide, thioamide, or sulfonamide bond reaction. In some embodiments, a linker is connected to an anti-TfR antibody and/or (e.g., and) molecular payload by a condensation reaction to form an oxime, hydrazone, or semicarbazide group existing between the linker and the anti-TfR antibody and/or (e.g., and) molecular payload.

In some embodiments, a linker is connected to an anti-TfR antibody and/or (e.g., and) molecular payload by a conjugate addition reactions between a nucleophile, e.g. an amine or a hydroxyl group, carbonate, and an electrophile, e.g. a carboxylic acid or an aldehyde. In some embodiments, a nucleophile may exist on a linker and an electrophile may exist on an anti-TfR antibody or molecular payload prior to a reaction between a linker and an anti-TfR antibody or molecular payload. In some embodiments, an electrophile may exist on a linker and a nucleophile may exist on an anti-TfR antibody or molecular payload prior to a reaction between a linker and an anti-TfR antibody or molecular payload. In some embodiments, an electrophile may be an azide, pentafluorophenyl, a silicon centers, a carbonyl, a carboxylic acid, an anhydride, an isocyanate, a thioisocyanate, a succinimidyl ester, a sulfosuccinimidyl ester, a maleimide, an alkyl halide, an alkyl pseudohalide, an epoxide, an episulfide, an aziridine, an aryl, an activated phosphorus center, and/or (e.g., and) an activated sulfur center. In some embodiments, a nucleophile may be an optionally substituted alkene, an optionally substituted alkyne, an optionally substituted aryl, an optionally substituted heterocyclyl, a hydroxyl group, an amino group, an alkylamino group, an anilido group, or a thiol group.

In some embodiments, the val-cit linker attached to a reactive chemical moiety (e.g., SPAAC for click chemistry conjugation) is conjugated to the anti-TfR antibody by a structure of:

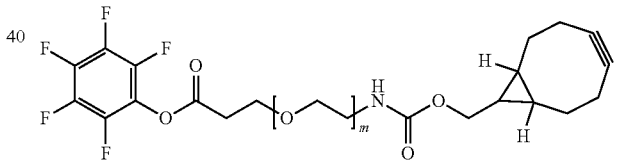

wherein m is any number from 0-10. In some embodiments, m is 4.

In some embodiments, the val-cit linker attached to a reactive chemical moiety (e.g., SPAAC for click chemistry conjugation) is conjugated to an anti-TfR antibody having a structure of:

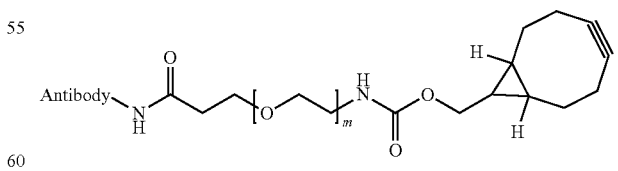

wherein m is any number from 0-10. In some embodiments, m is 4.

In some embodiments, the val-cit linker attached to a reactive chemical moiety (e.g., SPAAC for click chemistry conjugation) and conjugated to an anti-TfR antibody has a structure of:

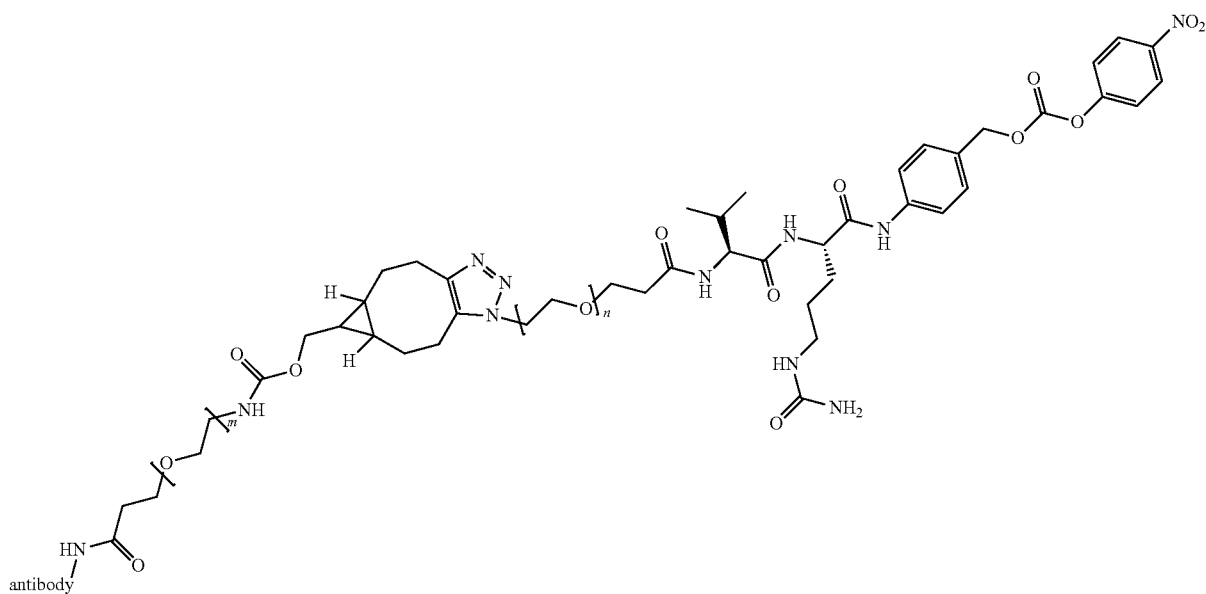

wherein n is any number from 0-10, wherein m is any number from 0-10. In some embodiments, n is 3 and/or (e.g., and) m is 4.

In some embodiments, the val-cit linker used to covalently link an anti-TfR antibody and a molecular payload (e.g., an oligonucleotide) has a structure of:

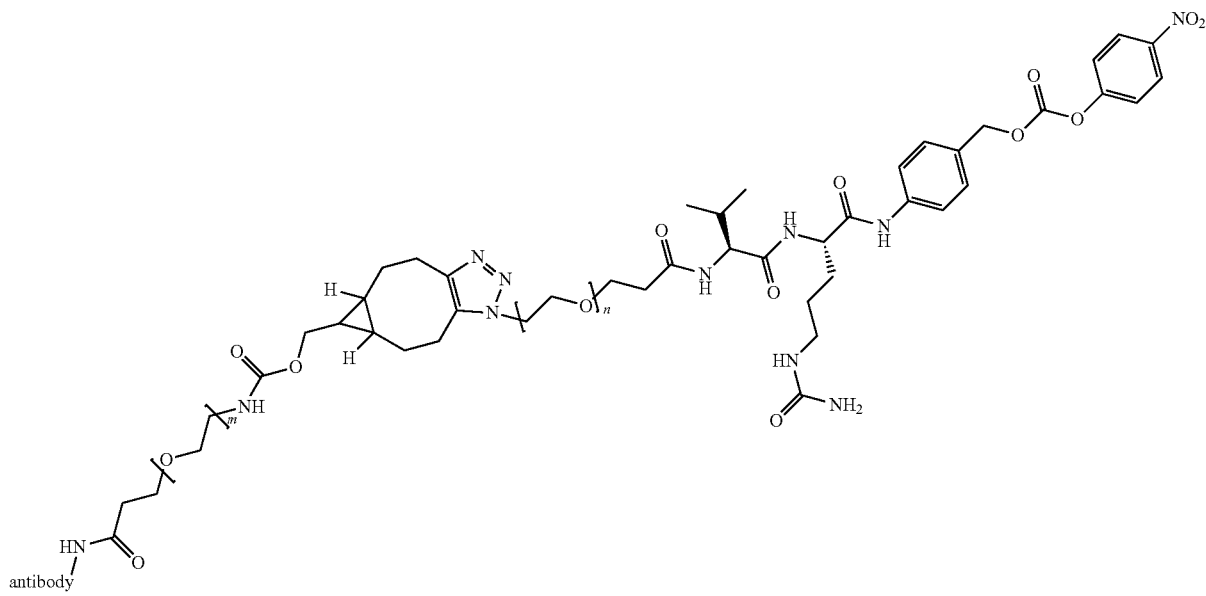

wherein n is 3 and m is 4.

In some embodiments, the val-cit linker that links the antibody and the molecular payload has a structure of:

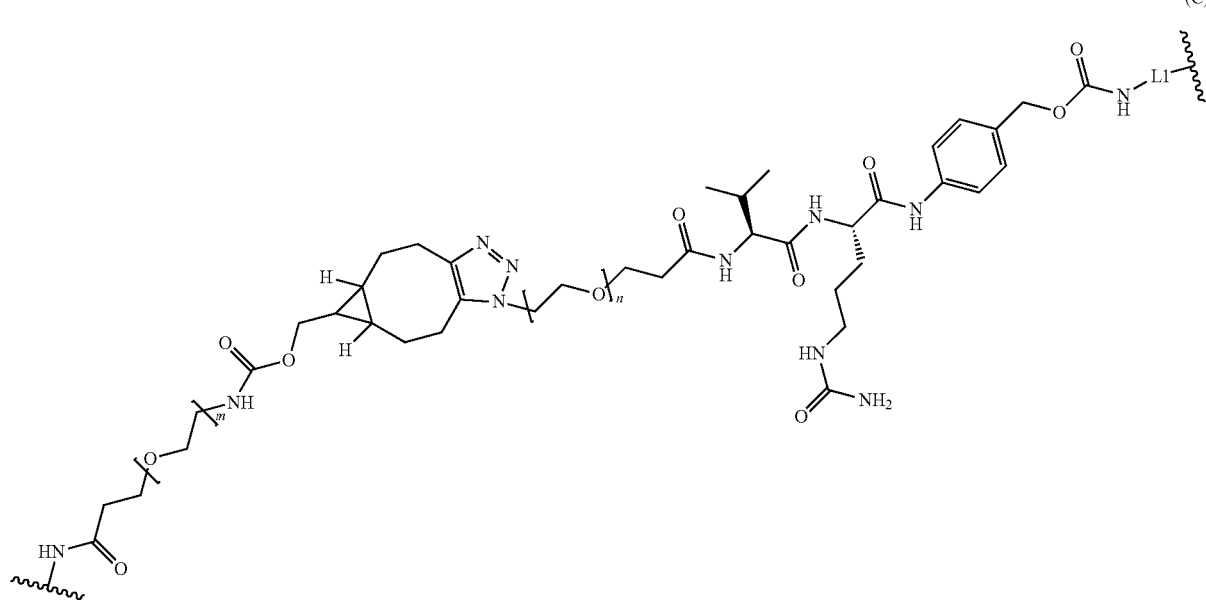

(C)

wherein n is any number from 0-10, wherein m is any number from 0-10. In some embodiments, n is 3 and/or (e.g., and) m is 4. In some embodiments, n is 3 and/or (e.g., and) m is 4. In some embodiments, X is NH (e.g., NH from an amine group of a lysine), S (e.g., S from a thiol group of a cysteine), or O (e.g., O from a hydroxyl group of a serine, threonine, or tyrosine) of the antibody.

In some embodiments, the complex described herein has a structure of:

wherein n is any number from 0-10, wherein m is any number from 0-10. In some embodiments, n is 3 and/or (e.g., and) m is 4.

In structures formula (A), (B), (C), and (D), L1, in some embodiments, is a spacer that is a substituted or unsubstituted aliphatic, substituted or unsubstituted heteroaliphatic, substituted or unsubstituted carbocyclylene, substituted or unsubstituted heterocyclylene, substituted or unsubstituted arylene, substituted or unsubstituted heteroarylene, —O—, —N($R^A$)—, —S—, —C(=O)—, —C(=O)O—, —C(=O)

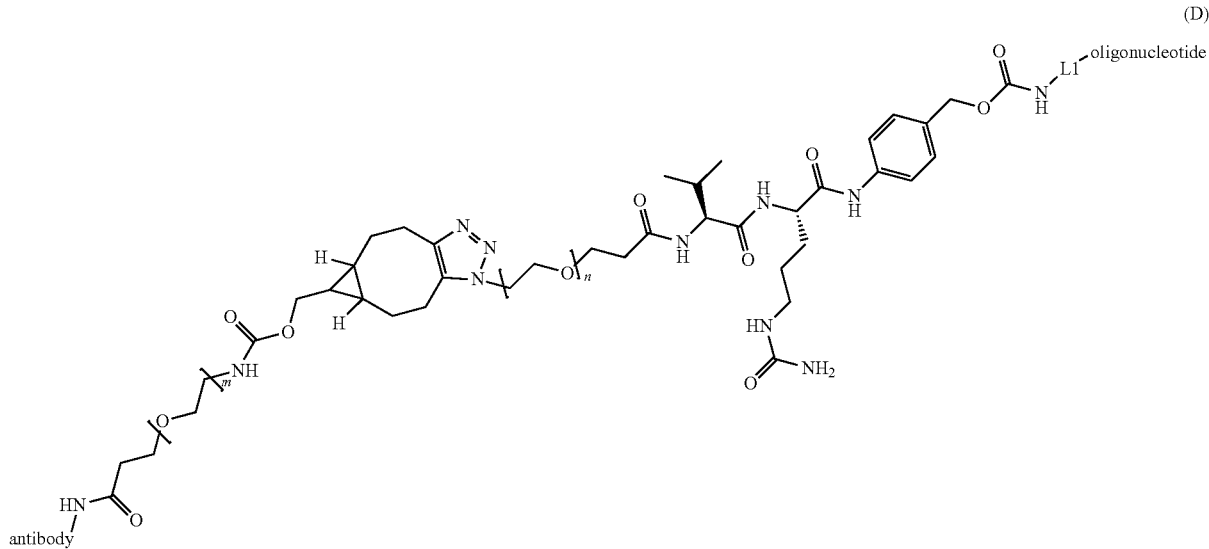

(D)

NR$^A$—, —NR$^A$C(=O)—, —NR$^A$C(=O)R$^A$—, —C(=O) R$^A$, —NR$^A$C(=O)O—, —NR$^A$C(=O)N(R$^A$)—, —OC(=O)—, —OC(=O)O—, —OC(=O)N(R$^A$)—, —S(O)$_2$NR$^A$—, —NR$^A$S(O)$_2$—, or a combination thereof.

In some embodiments, L1 is

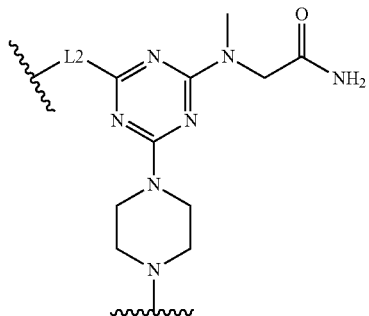

wherein the piperazine moiety links to the oligonucleotide, wherein L2 is

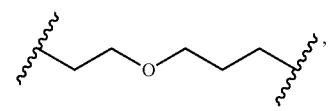

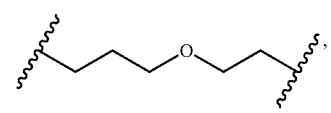

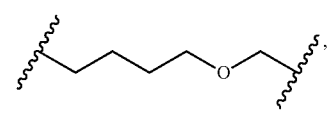

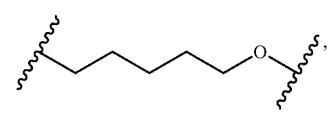

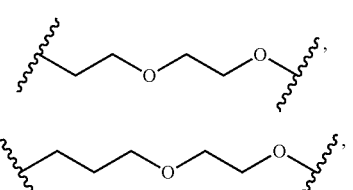

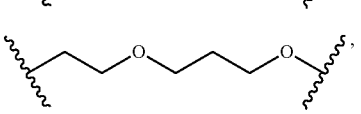

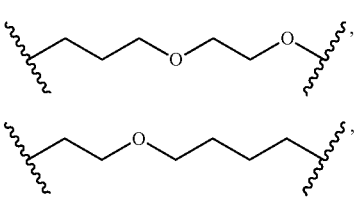

-continued

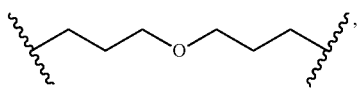

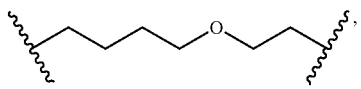

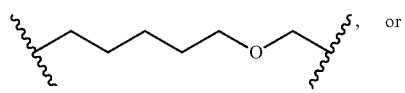, or

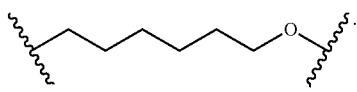.

In some embodiments, L1 is:

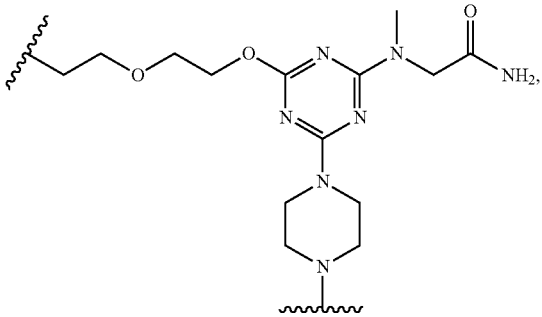 [SMILES: *CCOCCOc1nc(N(C)CC(N)=O)nc(N2CCN(*)CC2)n1]

wherein the piperazine moiety links to the oligonucleotide.

In some embodiments, L1 is

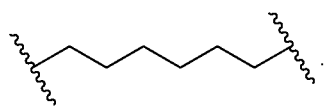 [SMILES: *CCCCCC*]

In some embodiments, L1 is linked to a 5' phosphate of the oligonucleotide.

In some embodiments, L1 is optional (e.g., need not be present).

In some embodiments, any one of the complexes described herein has a structure of:

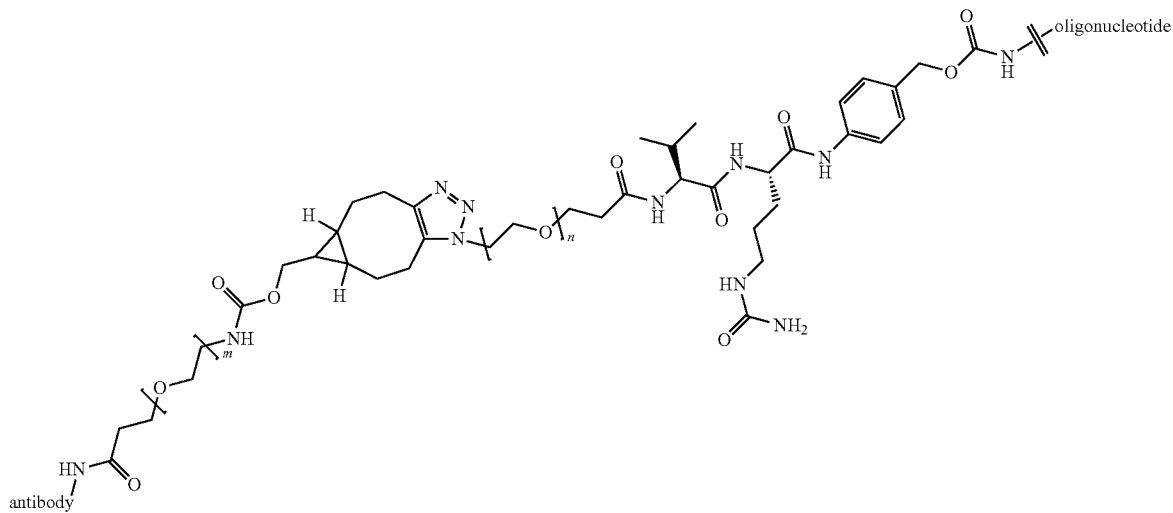

(E)

wherein n is 0-15 (e.g., 3) and m is 0-15 (e.g., 4).

C. Examples of Antibody-Molecular Payload Complexes

Further provided herein are non-limiting examples of complexes comprising any one the anti-TfR antibodies described herein covalently linked to any of the molecular payloads (e.g., an oligonucleotide) described herein. In some embodiments, the anti-TfR antibody (e.g., any one of the anti-TfR antibodies provided in Table 2) is covalently linked to a molecular payload (e.g., an oligonucleotide) via a linker. Any of the linkers described herein may be used. In some embodiments, if the molecular payload is an oligonucleotide, the linker is linked to the 5' end, the 3' end, or internally of the oligonucleotide. In some embodiments, the linker is linked to the anti-TfR antibody via a thiol-reactive linkage (e.g., via a cysteine in the anti-TfR antibody). In some embodiments, the linker (e.g., a Val-cit linker) is linked to the antibody (e.g., an anti-TfR antibody described herein) via an amine group (e.g., via a lysine in the antibody). In some embodiments, the molecular payload is a DMD targeting oligonucleotide (e.g., an oligonucleotide listed in Table 14). In some embodiments, the molecular payload is a DMD targeting oligonucleotide (e.g., an oligonucleotide provided by any one of SEQ ID NO: 437-1241, or complementary to any one of SEQ ID NO: 1242-2046).

An example of a structure of a complex comprising an anti-TfR antibody covalently linked to a molecular payload via a Val-cit linker is provided below:

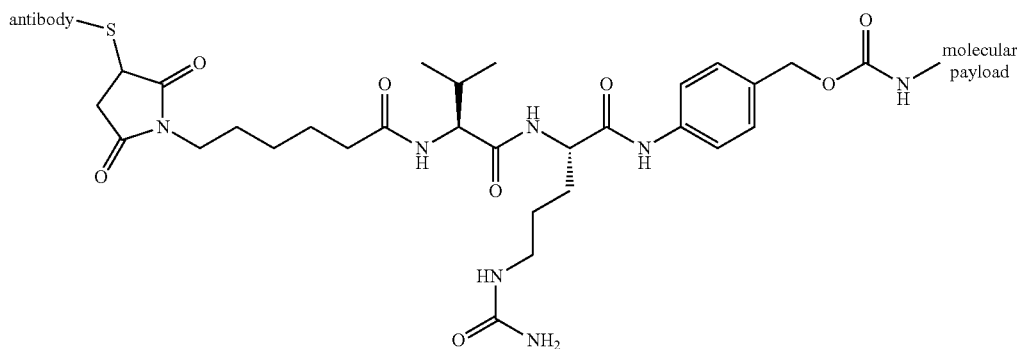

wherein the linker is linked to the antibody via a thiol-reactive linkage (e.g., via a cysteine in the antibody). In some embodiments, the molecular payload is a DMD targeting oligonucleotide (e.g., an oligonucleotide listed in Table 14). In some embodiments, the molecular payload is a DMD targeting oligonucleotide (e.g., an oligonucleotide provided by any one of SEQ ID NO: 437-1241, or complementary to any one of SEQ ID NO: 1242-2046).

Another example of a structure of a complex comprising an anti-TfR antibody covalently linked to a molecular payload via a Val-cit linker is provided below:

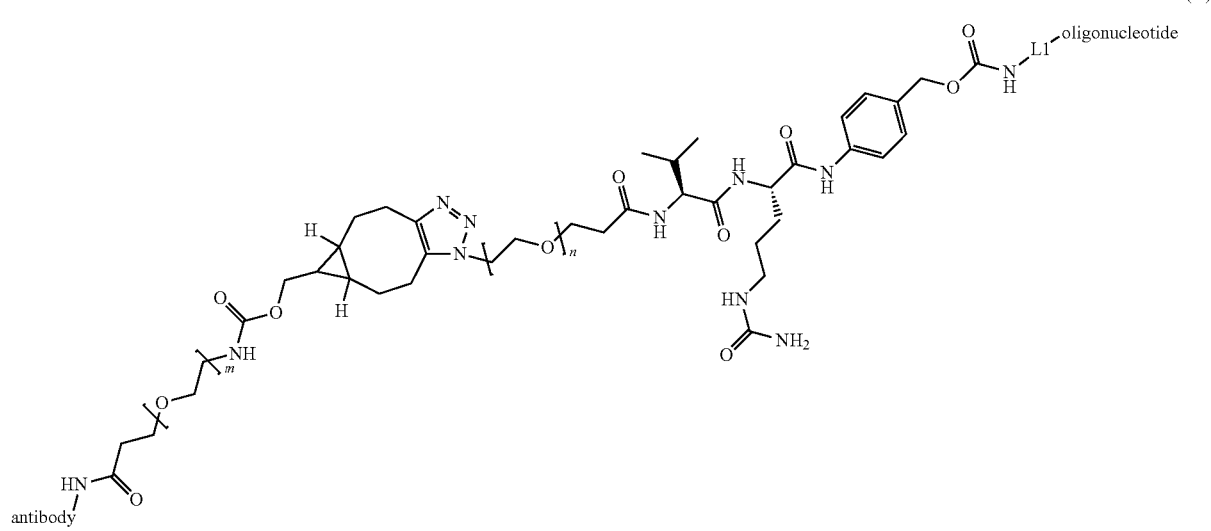

(D)

wherein n is a number between 0-10, wherein m is a number between 0-10, wherein the linker is linked to the antibody via an amine group (e.g., on a lysine residue), and/or (e.g., and) wherein the linker is linked to the oligonucleotide (e.g., at the 5' end, 3' end, or internally). In some embodiments, the linker is linked to the antibody via a lysine, the linker is linked to the oligonucleotide at the 5' end, n is 3, and m is 4. In some embodiments, the molecular payload is an oligonucleotide comprising a sense strand and an antisense strand, and, the linker is linked to the sense strand or the antisense strand at the 5' end or the 3' end.

It should be appreciated that antibodies can be linked to molecular payloads with different stochiometries, a property that may be referred to as a drug to antibody ratios (DAR) with the "drug" being the molecular payload. In some embodiments, one molecular payload is linked to an antibody (DAR=1). In some embodiments, two molecular payloads are linked to an antibody (DAR=2). In some embodiments, three molecular payloads are linked to an antibody (DAR=3). In some embodiments, four molecular payloads are linked to an antibody (DAR=4). In some embodiments, a mixture of different complexes, each having a different DAR, is provided. In some embodiments, an average DAR of complexes in such a mixture may be in a range of 1 to 3, 1 to 4, 1 to 5 or more. DAR may be increased by conjugating molecular payloads to different sites on an antibody and/or (e.g., and) by conjugating multimers to one or more sites on antibody. For example, a DAR of 2 may be achieved by conjugating a single molecular payload to two different sites on an antibody or by conjugating a dimer molecular payload to a single site of an antibody.

In some embodiments, the complex described herein comprises an anti-TfR antibody described herein (e.g., the 3-A4, 3-M12, and 5-H12 antibodies provided in Table 2 in an IgG or Fab form) covalently linked to a molecular payload. In some embodiments, the complex described herein comprises an anti-TfR antibody described herein (e.g., the 3-A4, 3-M12, and 5-H12 antibodies provided in Table 2 in an IgG or Fab form) covalently linked to molecular payload via a linker (e.g., a Val-cit linker). In some embodiments, the linker (e.g., a Val-cit linker) is linked to the antibody (e.g., an anti-TfR antibody described herein) via a thiol-reactive linkage (e.g., via a cysteine in the antibody). In some embodiments, the linker (e.g., a Val-cit linker) is linked to the antibody (e.g., an anti-TfR antibody described herein) via an amine group (e.g., via a lysine in the antibody). In some embodiments, the molecular payload is a DMD targeting oligonucleotide (e.g., an oligonucleotide listed in Table 14). In some embodiments, the molecular payload is a DMD targeting oligonucleotide (e.g., an oligonucleotide provided by any one of SEQ ID NO: 437-1241, or complementary to any one of SEQ ID NO: 1242-2046).

In some embodiments, in any one of the examples of complexes described herein, the molecular payload is a DMD targeting oligonucleotide comprising a region of complementarity of at least 15 consecutive nucleotides to a target sequence provided by any one of SEQ ID NO: 1242-2046. In some embodiments, in any one of the examples of complexes described herein, the molecular payload is a DMD targeting oligonucleotide comprising a region of at least 15 consecutive nucleotides of any one of SEQ ID NO: 437-1241. In some embodiments, in any one of the examples of complexes described herein, the molecular payload is a DMD targeting oligonucleotide comprising a region of complementarity of at least 5 consecutive nucleotides of an ESE listed in Table 15. In some embodiments, in any one of the examples of complexes described herein, the molecular payload is a DMD targeting oligonucleotide selected from the oligonucleotides listed in Table 14. In some embodiments, in any one of the examples of complexes described herein, the molecular payload is a DMD targeting oligonucleotide selected from the oligonucleotides provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a CDR-H1, a CDR-H2, and a CDR-H3 that are the same as the CDR-H1, CDR-H2, and CDR-H3 shown in Table 2; and a CDR-L1, a CDR-L2, and a CDR-L3 that are the same as the CDR-L1, CDR-L2, and CDR-L3 shown in Table 2. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a VH comprising the amino acid sequence of SEQ ID NO: 69, SEQ ID NO: 71, or SEQ ID NO: 72, and a VL comprising the amino acid sequence of SEQ ID NO: 70. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a VH comprising the amino acid sequence of SEQ ID NO: 73 or SEQ ID NO: 76, and a VL comprising the amino acid sequence of SEQ ID NO: 74. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a VH comprising the amino acid sequence of SEQ ID NO: 73 or SEQ ID NO: 76, and a VL comprising the amino acid sequence of SEQ ID NO: 75. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a VH comprising the amino acid sequence of SEQ ID NO: 77, and a VL comprising the amino acid sequence of SEQ ID NO: 78. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a VH comprising the amino acid sequence of SEQ ID NO: 77 or SEQ ID NO: 79, and a VL comprising the amino acid sequence of SEQ ID NO: 80. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a heavy chain comprising the amino acid sequence of SEQ ID NO: 84, SEQ ID NO: 86 or SEQ ID NO: 87 and a light chain comprising the amino acid sequence of SEQ ID NO: 85. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a heavy chain comprising the amino acid sequence of SEQ ID NO: 88 or SEQ ID NO: 91, and a light chain comprising the amino acid sequence of SEQ ID NO: 89. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a heavy chain comprising the amino acid sequence of SEQ ID NO: 88 or SEQ ID NO: 91, and a light chain comprising the amino acid sequence of SEQ ID NO: 90. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a heavy chain comprising the amino acid sequence of SEQ ID NO: 92 or SEQ ID NO: 94, and a light chain comprising the amino acid sequence of SEQ ID NO: 95. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a heavy chain comprising the amino acid sequence of SEQ ID NO: 92, and a light chain comprising the amino acid sequence of SEQ ID NO: 93. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a heavy chain comprising the amino acid sequence of SEQ ID NO: 97, SEQ ID NO: 98, or SEQ ID NO: 99 and a VL comprising the amino acid sequence of SEQ ID NO: 85. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a heavy chain comprising the amino acid sequence of SEQ ID NO: 100 or SEQ ID NO: 101 and a light chain comprising the amino acid sequence of SEQ ID NO: 89. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a heavy chain comprising the amino acid sequence of SEQ ID NO: 100 or SEQ ID NO: 101 and a light chain comprising the amino acid sequence of SEQ ID NO: 90. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a heavy chain comprising the amino acid sequence of SEQ ID NO: 102 and a light chain comprising the amino acid sequence of SEQ ID NO: 93. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked to a molecular payload, wherein the anti-TfR antibody comprises a heavy chain comprising the amino acid sequence of SEQ ID NO: 102 or SEQ ID NO: 103 and a light chain comprising the amino acid sequence of SEQ ID NO: 95. In some embodiments, the molecular payload is a DMD targeting oligonucleotide (e.g., an oligonucleotide listed in Table 14). In some embodiments, the molecular payload is an oligonucleotide provided by any one of SEQ ID NO: 437-1241, or complementary to any one of SEQ ID NO: 1242-2046.

In some embodiments, the complex described herein comprises an anti-TfR antibody covalently linked via a lysine to the 5' end of an oligonucleotide, wherein the anti-TfR antibody comprises a heavy chain comprising the amino acid sequence of SEQ ID NO: 84 and a light chain comprising the amino acid sequence of in SEQ ID NO: 85; wherein the complex has the structure of:

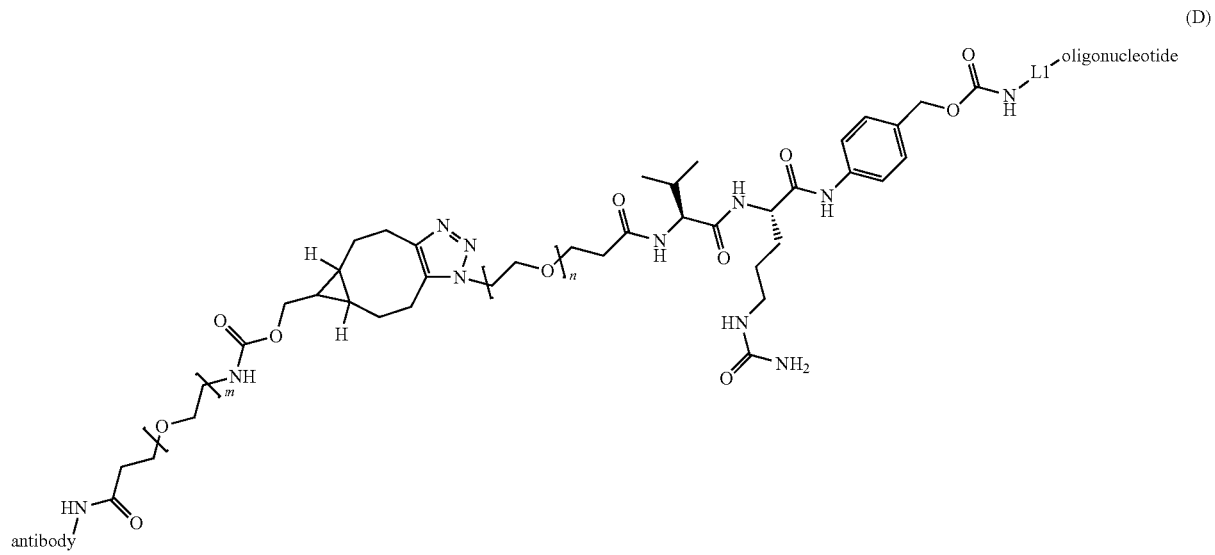

(D)

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR antibody covalently linked via a lysine to the 5' end of an oligonucleotide, wherein the anti-TfR antibody comprises a heavy chain comprising the amino acid sequence of SEQ ID NO: 86 and a light chain comprising the amino acid sequence of in SEQ ID NO: 85; wherein the complex has the structure of:

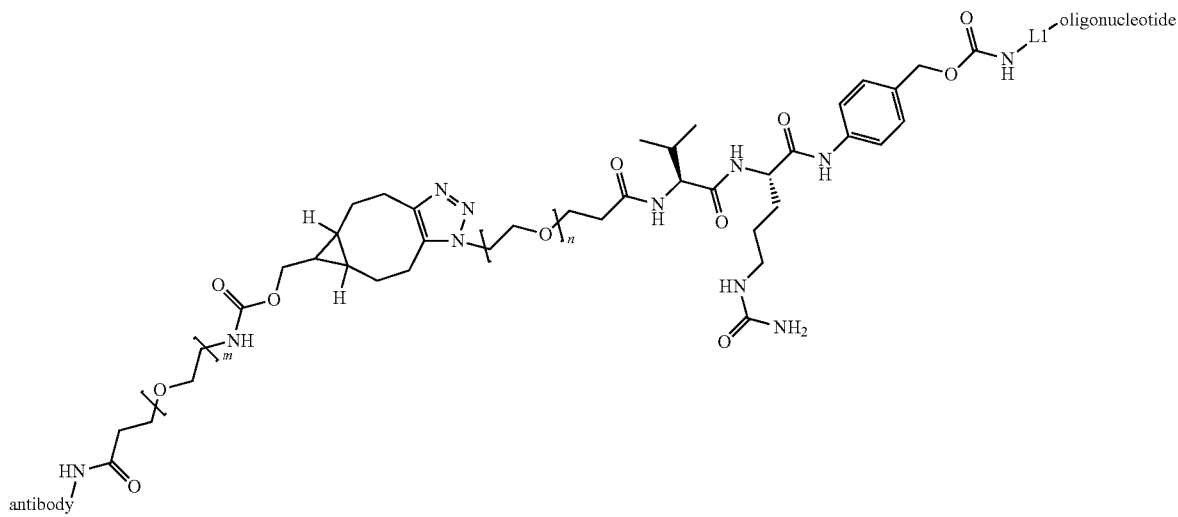

(D)

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR antibody covalently linked via a lysine to the 5' end of an oligonucleotide, wherein the anti-TfR antibody comprises a heavy chain comprising the amino acid sequence of SEQ ID NO: 87 and a light chain comprising the amino acid sequence of in SEQ ID NO: 85; wherein the complex has the structure of:

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR antibody covalently linked via a lysine to the 5' end of an oligonucleotide, wherein the anti-TfR antibody comprises a heavy chain comprising the amino acid sequence of SEQ ID NO: 88 and a light chain comprising the amino acid sequence of in SEQ ID NO: 89; wherein the complex has the structure of:

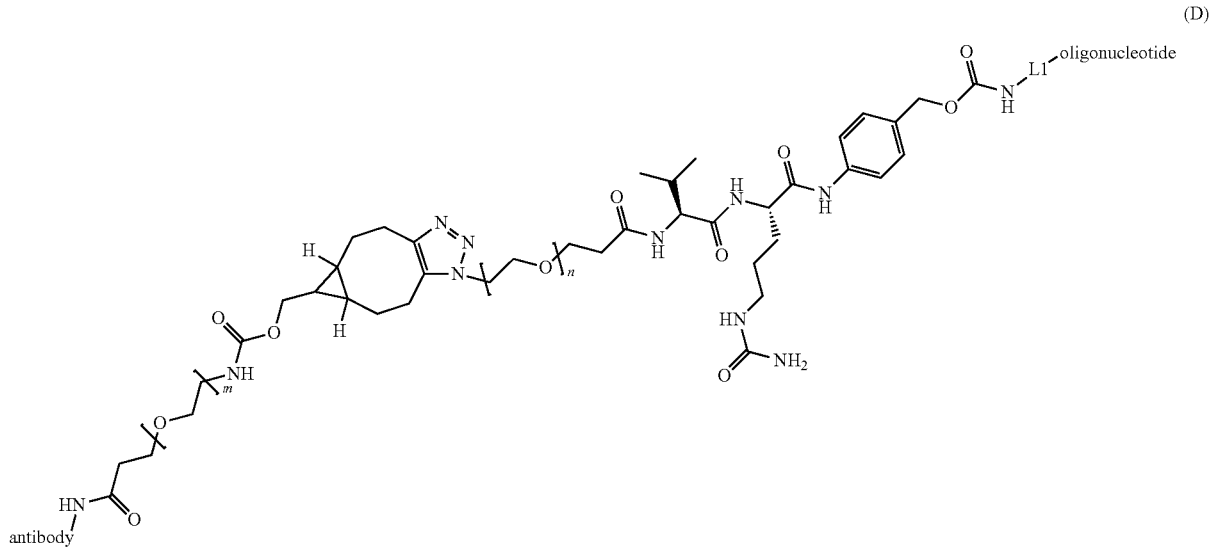

(D)

(D)

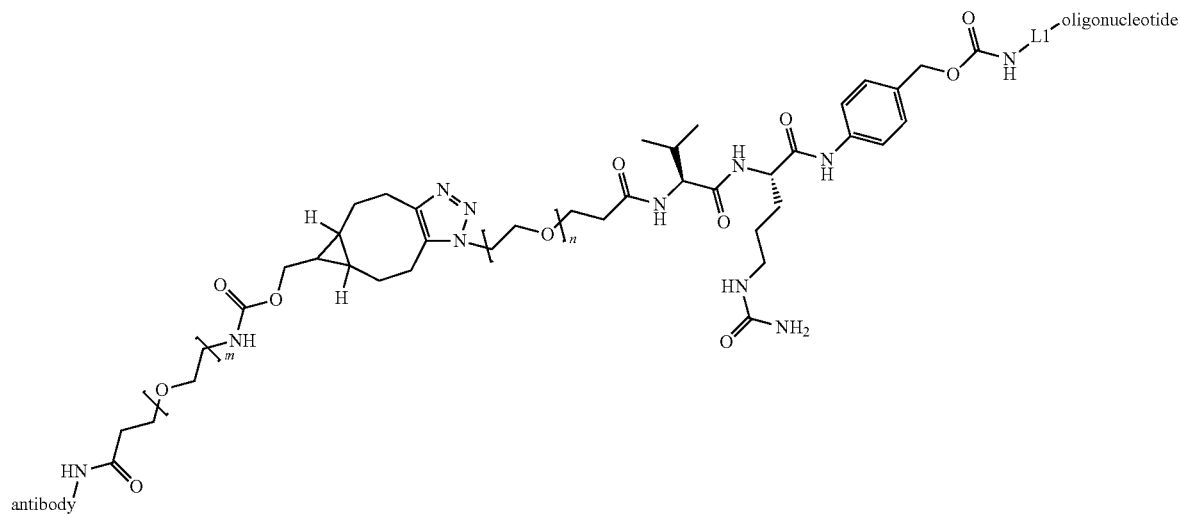

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR antibody covalently linked via a lysine to the 5' end of an oligonucleotide, wherein the anti-TfR antibody comprises a heavy chain comprising the amino acid sequence of SEQ ID NO: 88 and a light chain comprising the amino acid sequence of in SEQ ID NO: 90; wherein the complex has the structure of:

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR antibody covalently linked via a lysine to the 5' end of an oligonucleotide, wherein the anti-TfR antibody comprises a heavy chain comprising the amino acid sequence of SEQ ID NO: 91 and a light chain comprising the amino acid sequence of in SEQ ID NO: 89; wherein the complex has the structure of:

(D)

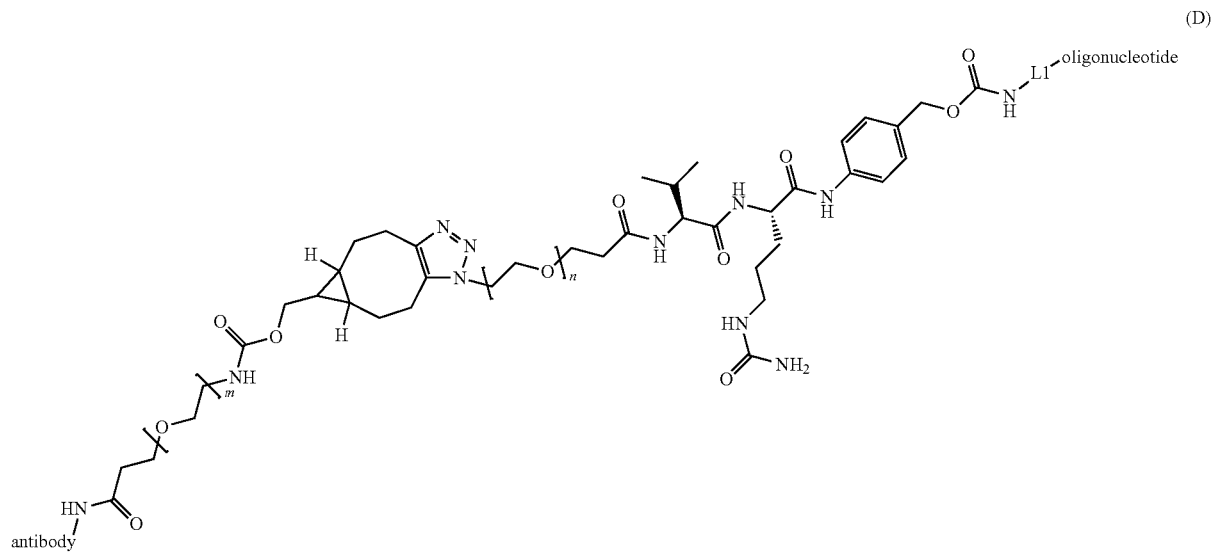

(D)

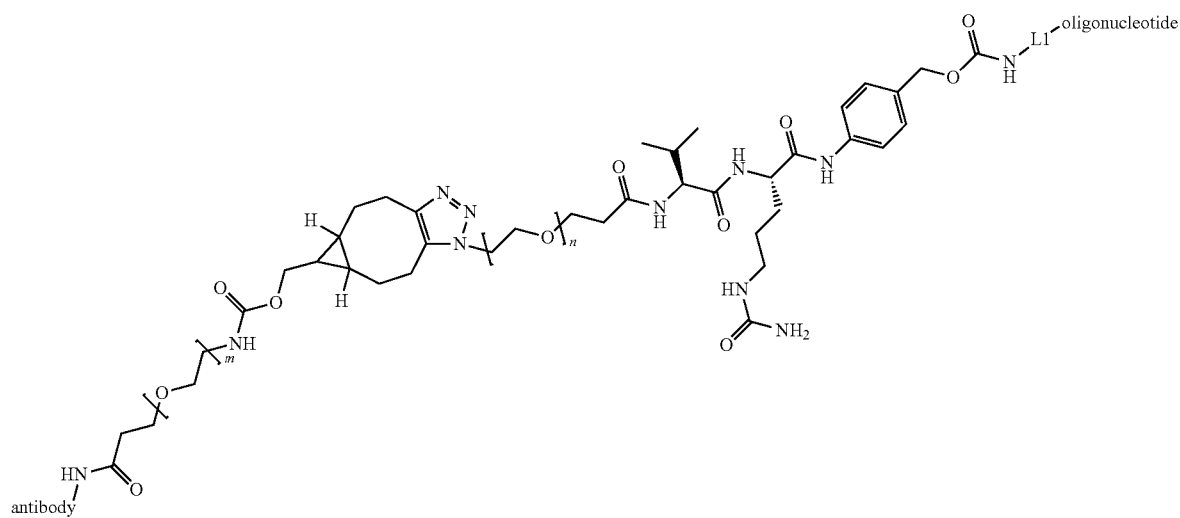

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR antibody covalently linked via a lysine to the 5' end of an oligonucleotide, wherein the anti-TfR antibody comprises a heavy chain comprising the amino acid sequence of SEQ ID NO: 91 and a light chain comprising the amino acid sequence of in SEQ ID NO: 90; wherein the complex has the structure of:

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR antibody covalently linked via a lysine to the 5' end of an oligonucleotide, wherein the anti-TfR antibody comprises a heavy chain comprising the amino acid sequence of SEQ ID NO: 92 and a light chain comprising the amino acid sequence of in SEQ ID NO: 93; wherein the complex has the structure of:

(D)

(D)

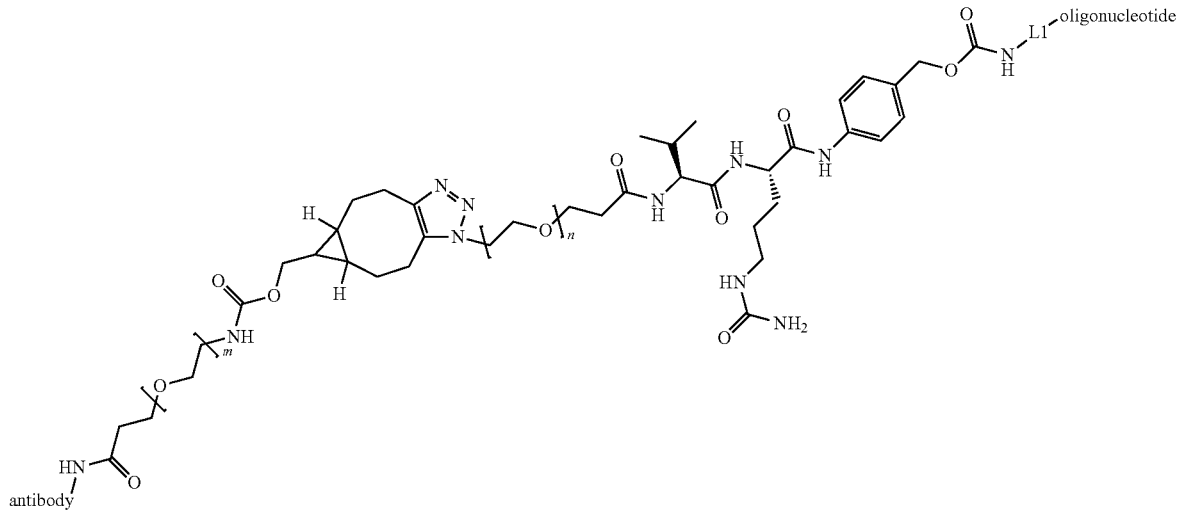

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR antibody covalently linked via a lysine to the 5' end of an oligonucleotide, wherein the anti-TfR antibody comprises a heavy chain comprising the amino acid sequence of SEQ ID NO: 94 and a light chain comprising the amino acid sequence of in SEQ ID NO: 95; wherein the complex has the structure of:

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR antibody covalently linked via a lysine to the 5' end of an oligonucleotide, wherein the anti-TfR antibody comprises a heavy chain comprising the amino acid sequence of SEQ ID NO: 92 and a light chain comprising the amino acid sequence of in SEQ ID NO: 95; wherein the complex has the structure of:

(D)

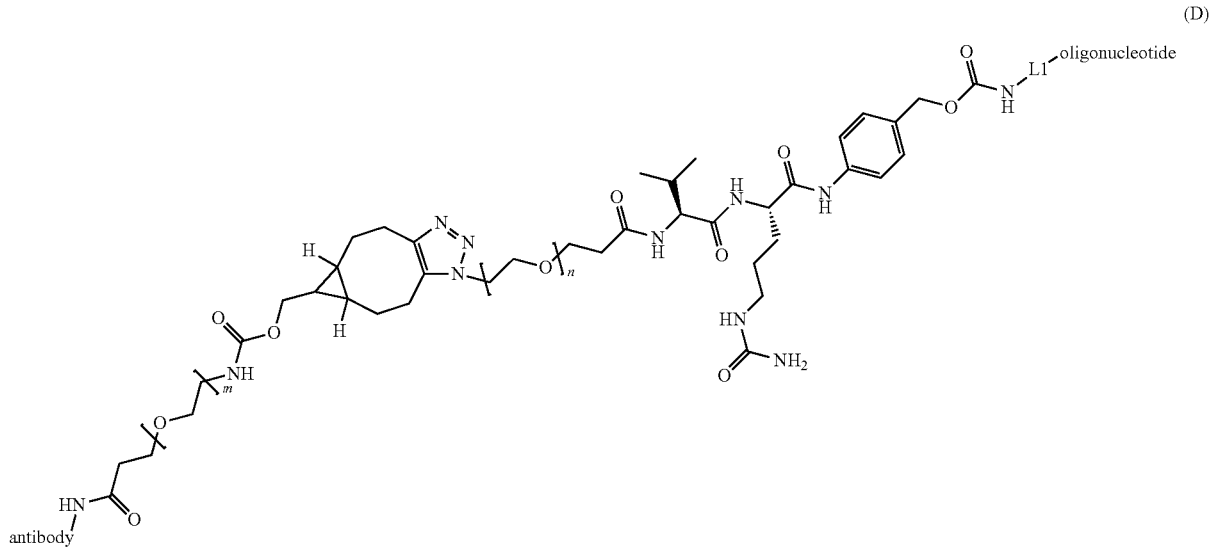

(D)

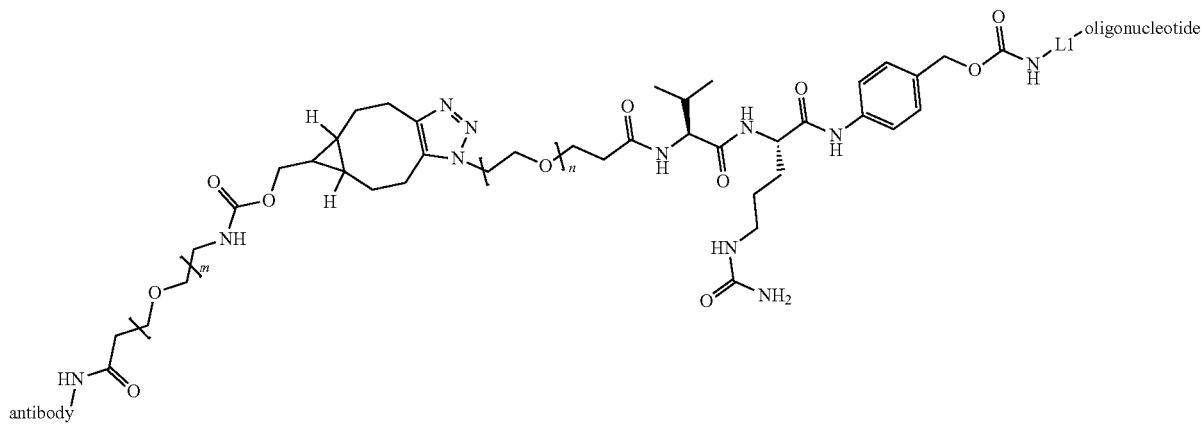

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a VH comprising the amino acid sequence of SEQ ID NO: 69 and a VL comprising the amino acid sequence of in SEQ ID NO: 70; wherein the complex has the structure of:

(D)

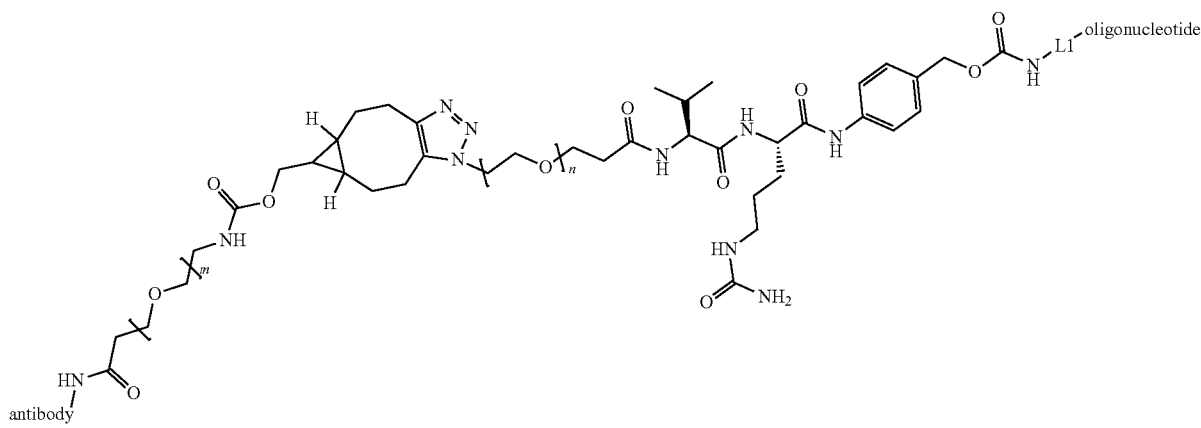

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a VH comprising the amino acid sequence of SEQ ID NO: 71 and a VL comprising the amino acid sequence of in SEQ ID NO: 70; wherein the complex has the structure of:

(D)

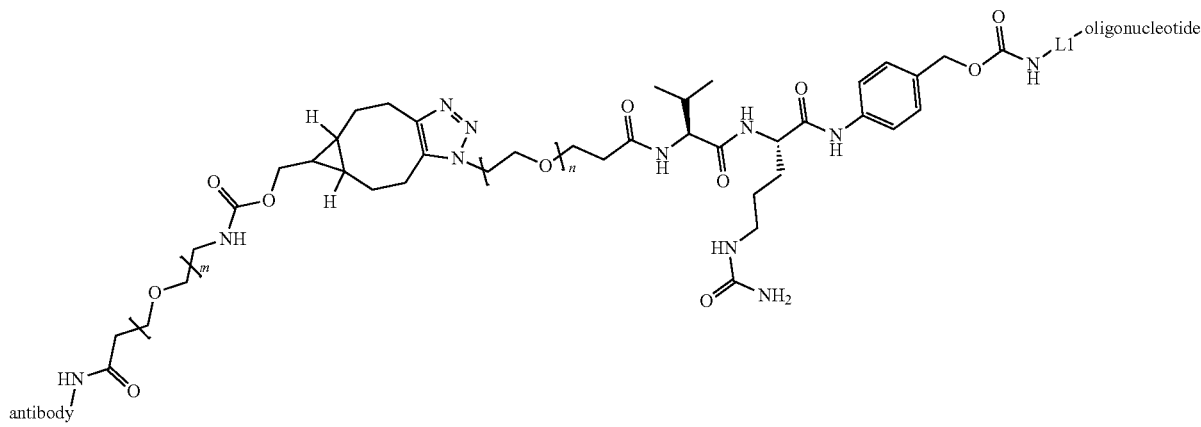

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a VH comprising the amino acid sequence of SEQ ID NO: 72 and a VL comprising the amino acid sequence of in SEQ ID NO: 70; wherein the complex has the structure of:

(D)

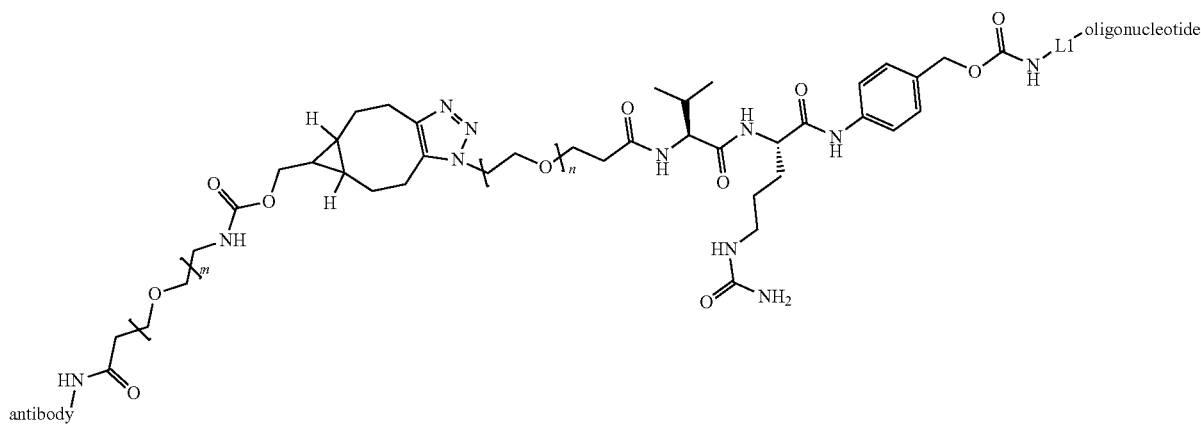

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a VH comprising the amino acid sequence of SEQ ID NO: 73 and a VL comprising the amino acid sequence of in SEQ ID NO: 74; wherein the complex has the structure of:

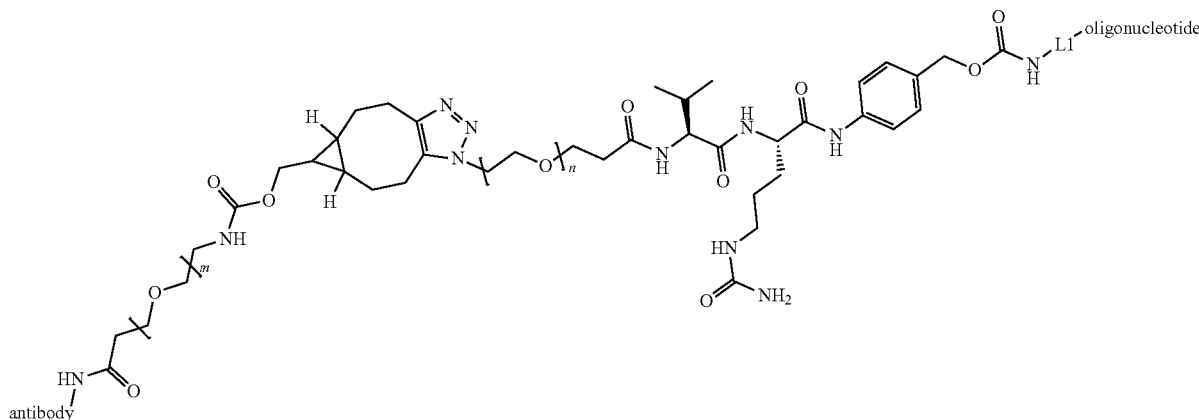

(D)

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a VH comprising the amino acid sequence of SEQ ID NO: 73 and a VL comprising the amino acid sequence of in SEQ ID NO: 75; wherein the complex has the structure of:

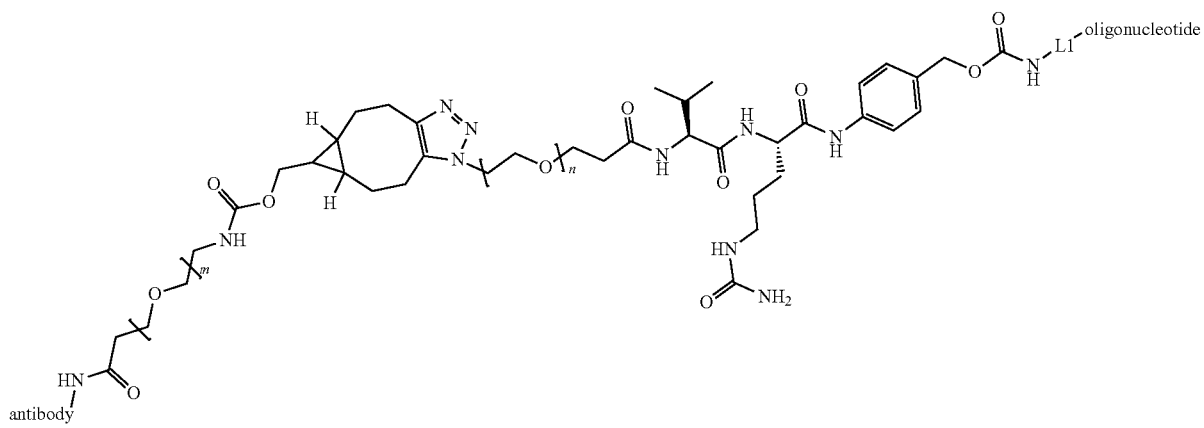

(D)

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a VH comprising the amino acid sequence of SEQ ID NO: 76 and a VL comprising the amino acid sequence of in SEQ ID NO: 74; wherein the complex has the structure of:

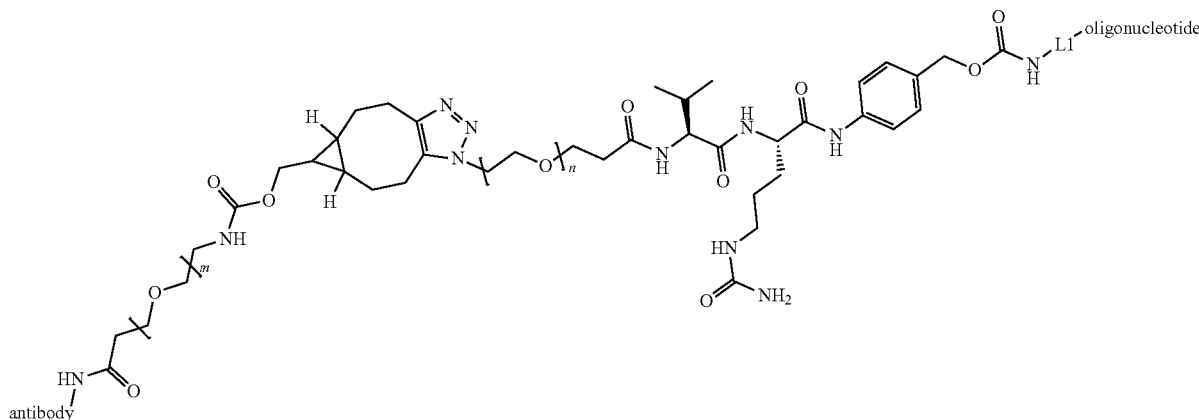

(D)

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a VH comprising the amino acid sequence of SEQ ID NO: 76 and a VL comprising the amino acid sequence of in SEQ ID NO: 75; wherein the complex has the structure of:

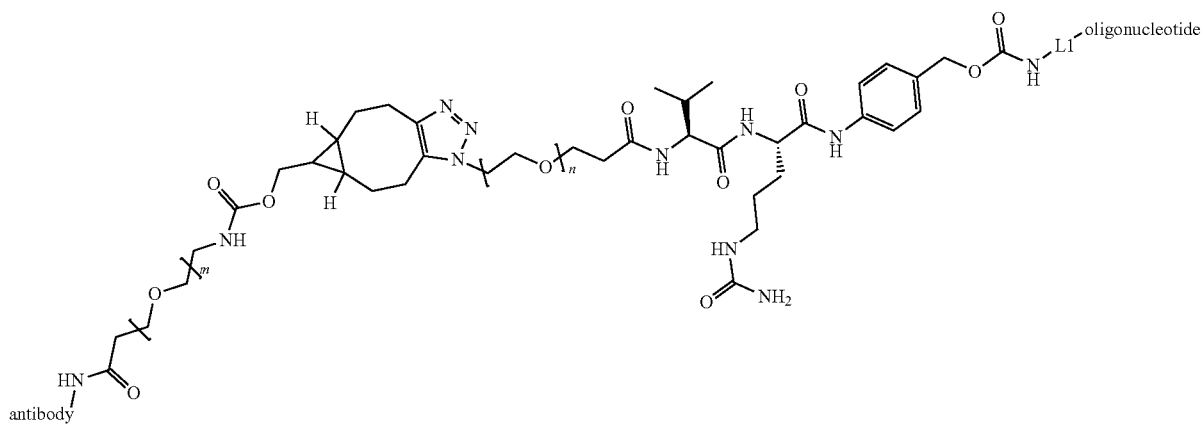

(D)

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a VH comprising the amino acid sequence of SEQ ID NO: 77 and a VL comprising the amino acid sequence of in SEQ ID NO: 78; wherein the complex has the structure of:

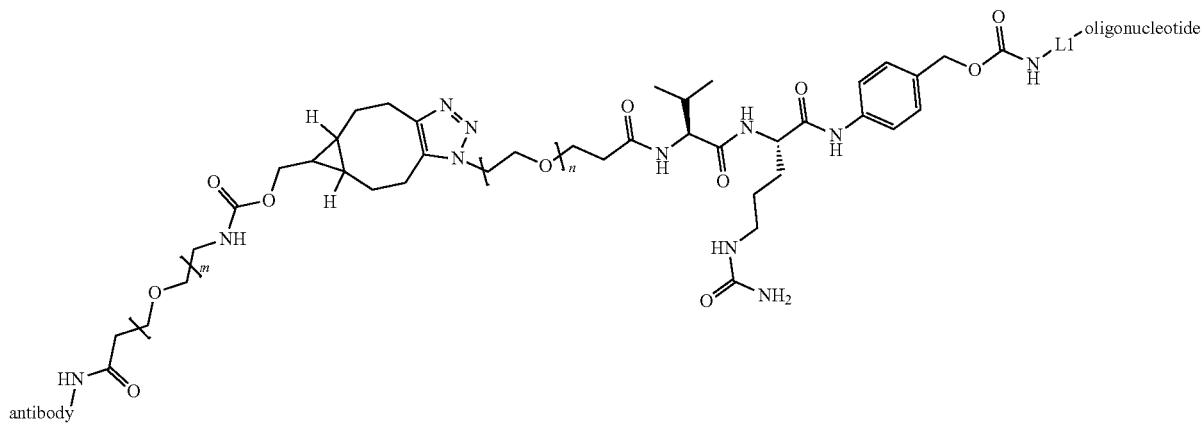

(D)

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a VH comprising the amino acid sequence of SEQ ID NO: 79 and a VL comprising the amino acid sequence of in SEQ ID NO: 80; wherein the complex has the structure of:

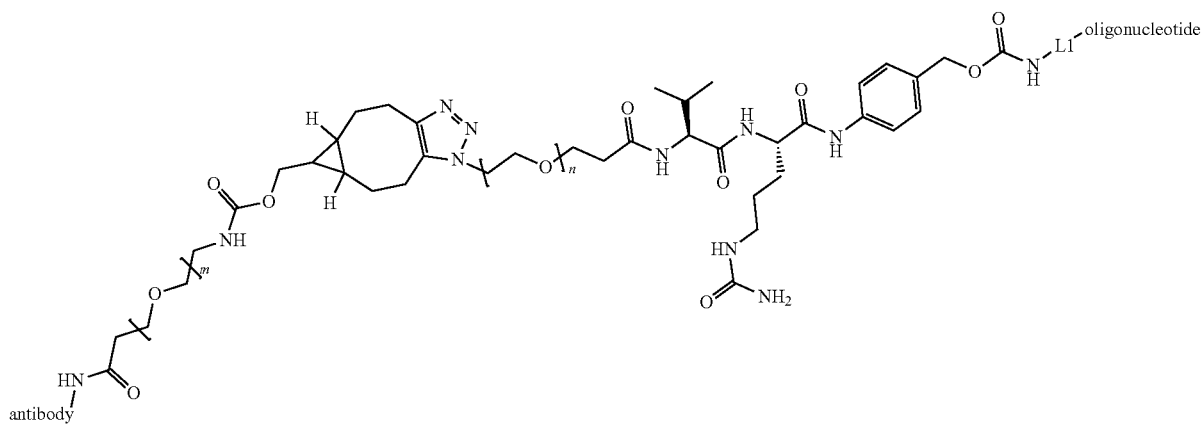

(D)

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a VH comprising the amino acid sequence of SEQ ID NO: 77 and a VL comprising the amino acid sequence of in SEQ ID NO: 80; wherein the complex has the structure of:

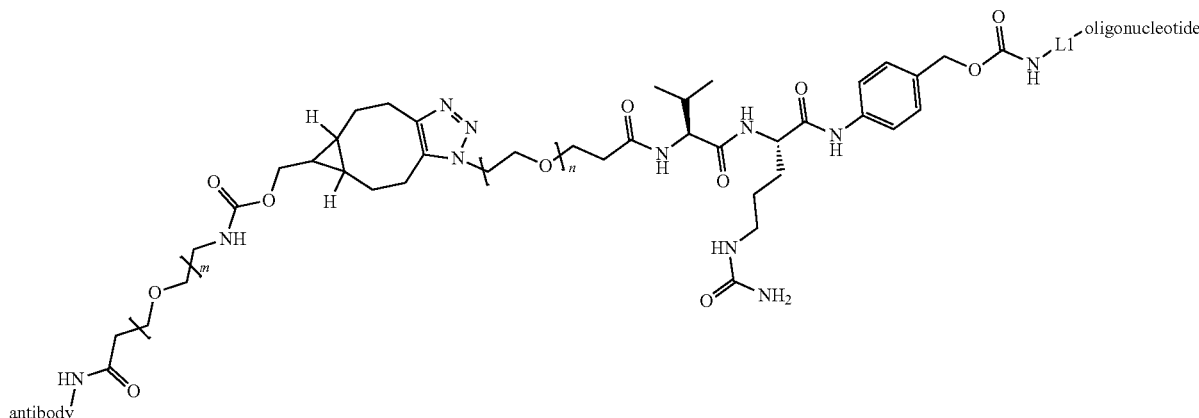

(D)

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a heavy chain comprising the amino acid sequence of SEQ ID NO: 97 and a light chain comprising the amino acid sequence of in SEQ ID NO: 85; wherein the complex has the structure of:

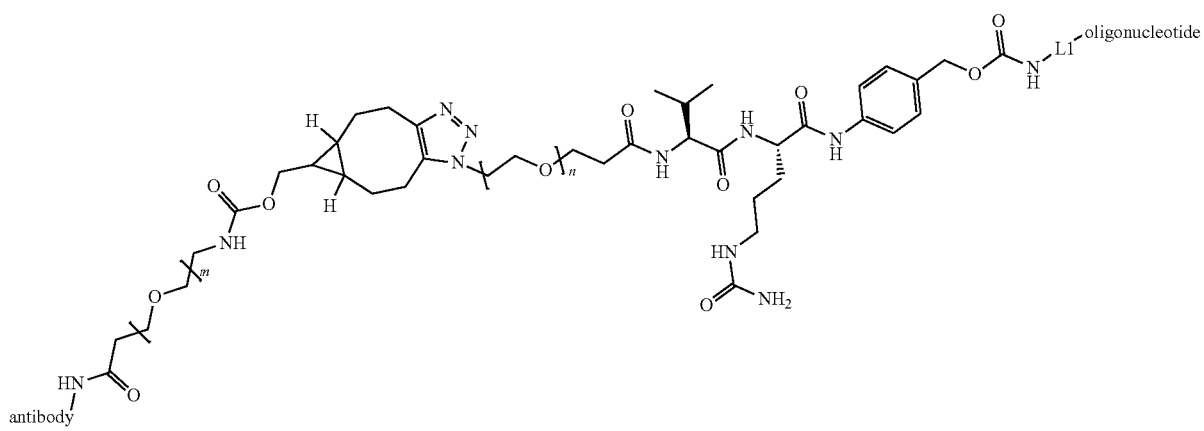

(D)

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a heavy chain comprising the amino acid sequence of SEQ ID NO: 98 and a light chain comprising the amino acid sequence of in SEQ ID NO: 85; wherein the complex has the structure of:

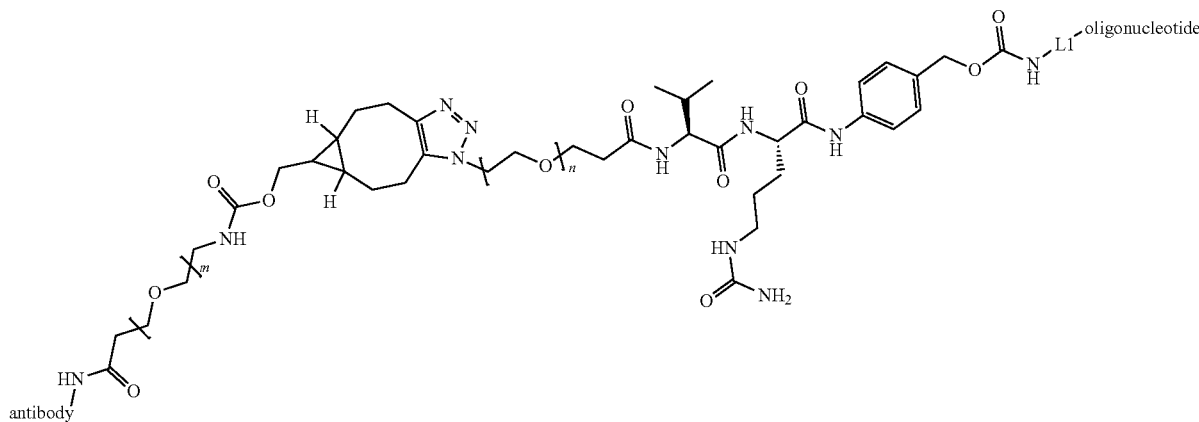

(D)

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a heavy chain comprising the amino acid sequence of SEQ ID NO: 99 and a light chain comprising the amino acid sequence of in SEQ ID NO: 85; wherein the complex has the structure of:

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a heavy chain comprising the amino acid sequence of SEQ ID NO: 100 and a light chain comprising the amino acid sequence of in SEQ ID NO: 89; wherein the complex has the structure of:

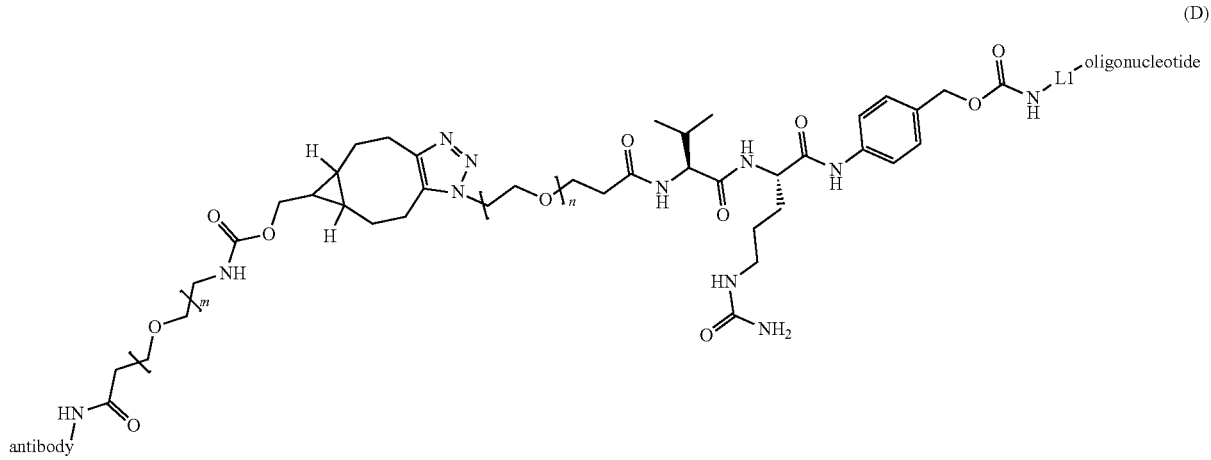

(D)

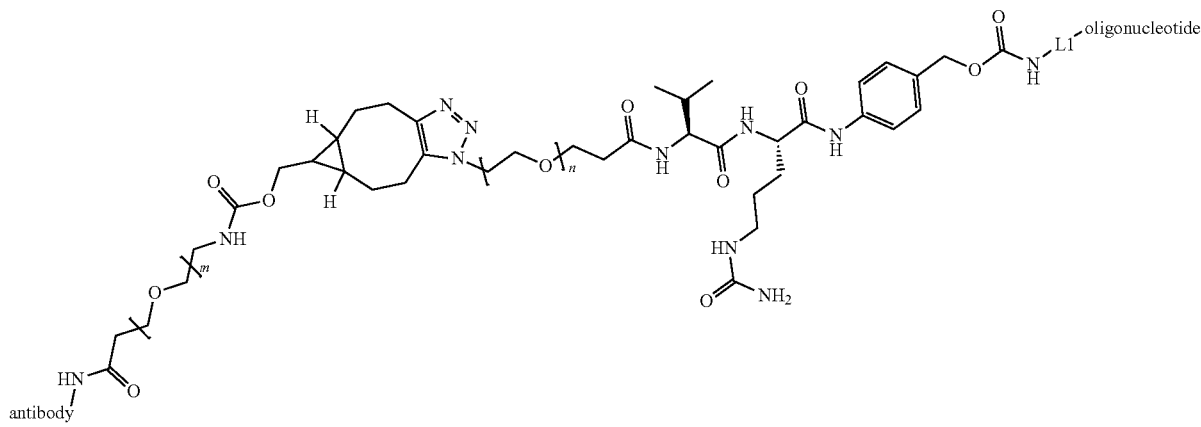

(D)

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a heavy chain comprising the amino acid sequence of SEQ ID NO: 100 and a light chain comprising the amino acid sequence of in SEQ ID NO: 90; wherein the complex has the structure of:

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a heavy chain comprising the amino acid sequence of SEQ ID NO: 101 and a light chain comprising the amino acid sequence of in SEQ ID NO: 89; wherein the complex has the structure of:

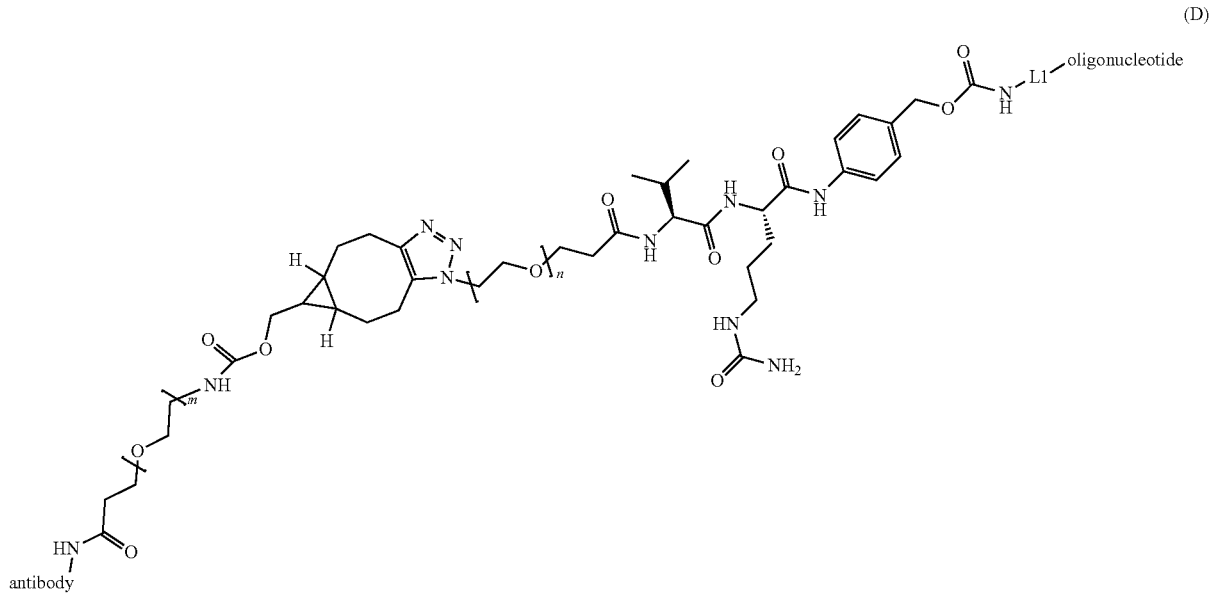

(D)

(D)

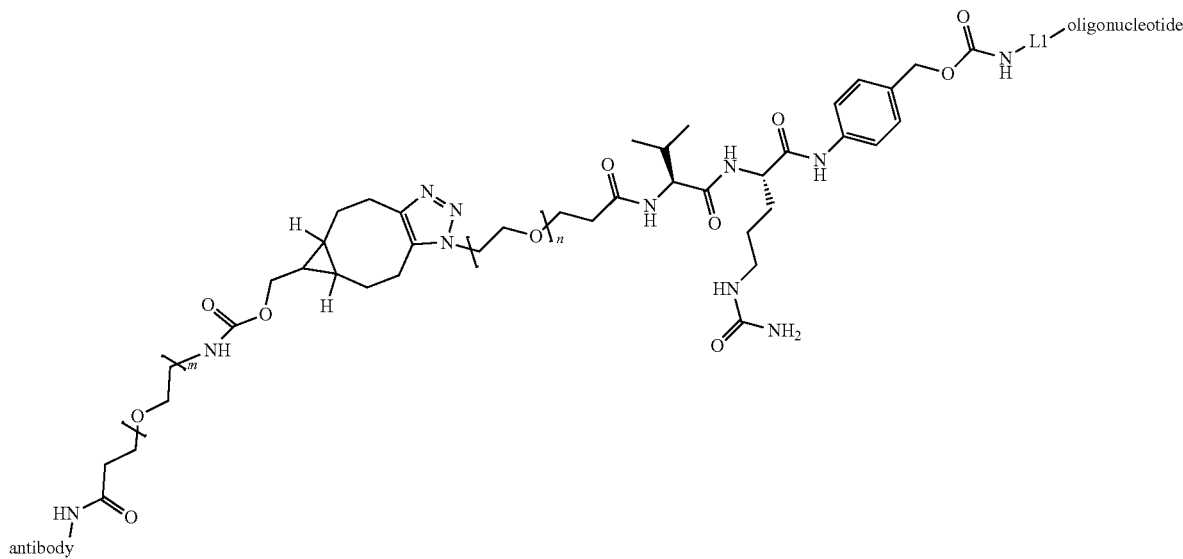

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a heavy chain comprising the amino acid sequence of SEQ ID NO: 101 and a light chain comprising the amino acid sequence of in SEQ ID NO: 90; wherein the complex has the structure of:

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a heavy chain comprising the amino acid sequence of SEQ ID NO: 102 and a light chain comprising the amino acid sequence of in SEQ ID NO: 93; wherein the complex has the structure of:

(D)

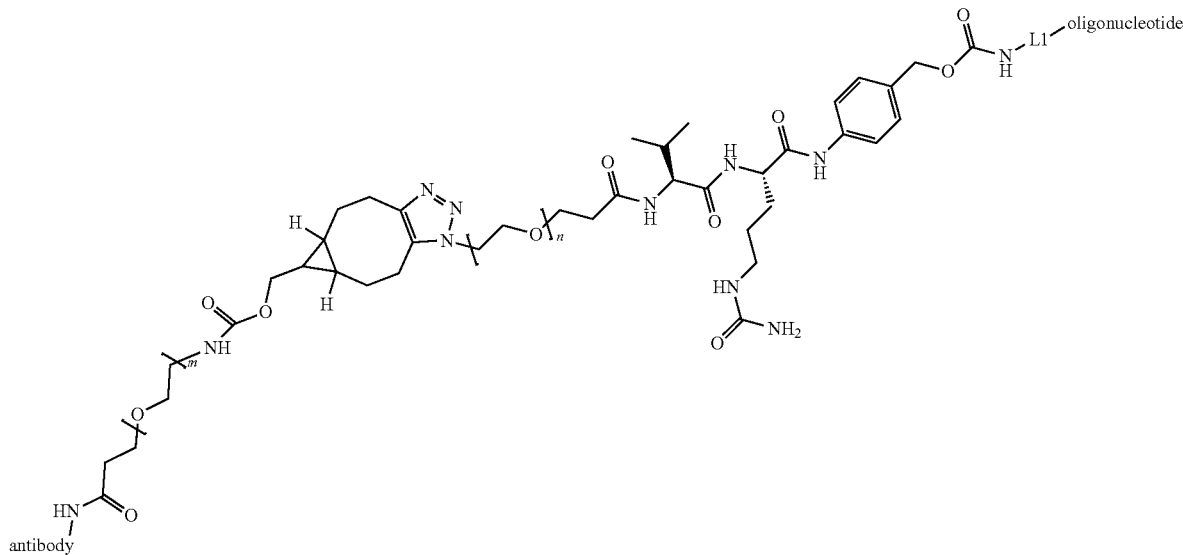

(D)

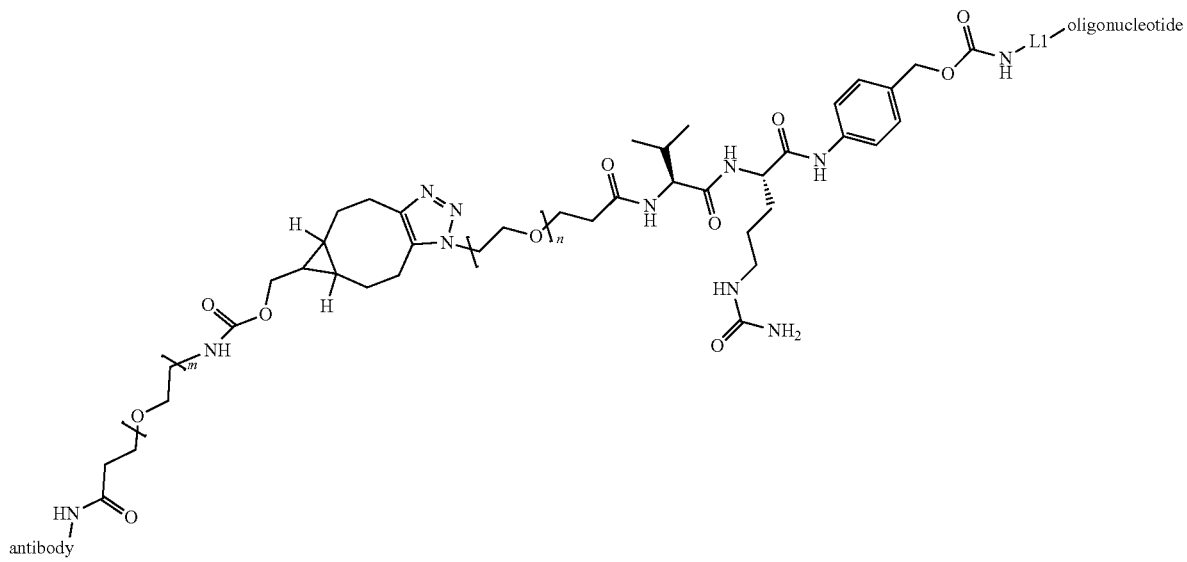

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a heavy chain comprising the amino acid sequence of SEQ ID NO: 103 and a light chain comprising the amino acid sequence of in SEQ ID NO: 95; wherein the complex has the structure of:

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, the complex described herein comprises an anti-TfR Fab covalently linked via a lysine to the 5' end of an oligonucleotide, wherein the anti-TfR Fab comprises a heavy chain comprising the amino acid sequence of SEQ ID NO: 102 and a light chain comprising the amino acid sequence of in SEQ ID NO: 95; wherein the complex has the structure of:

(D)

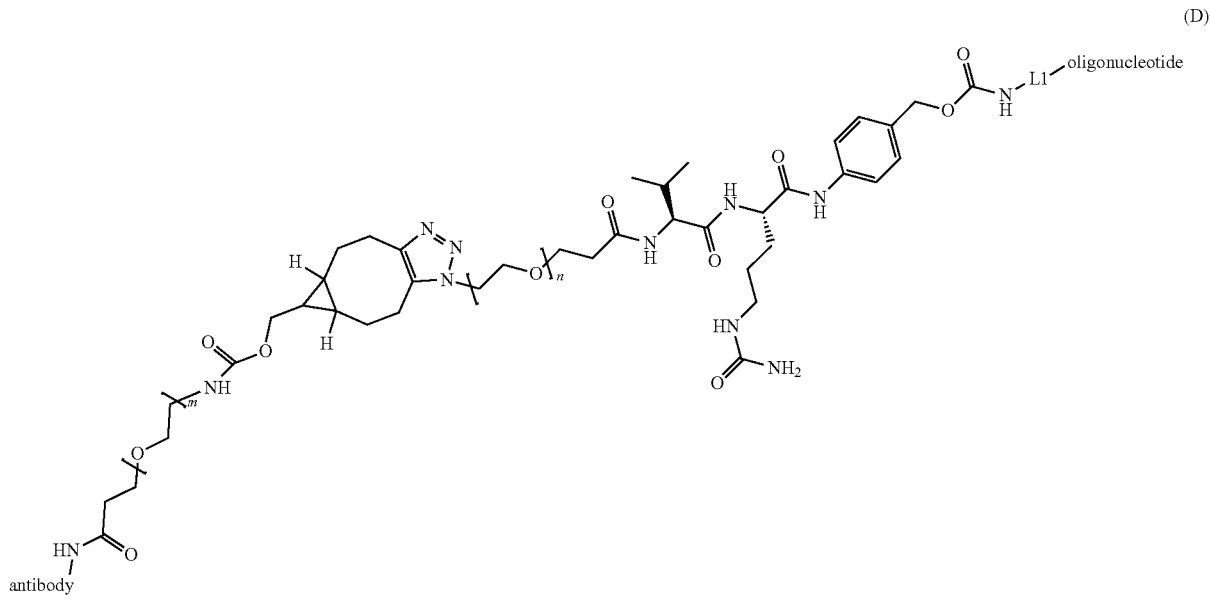

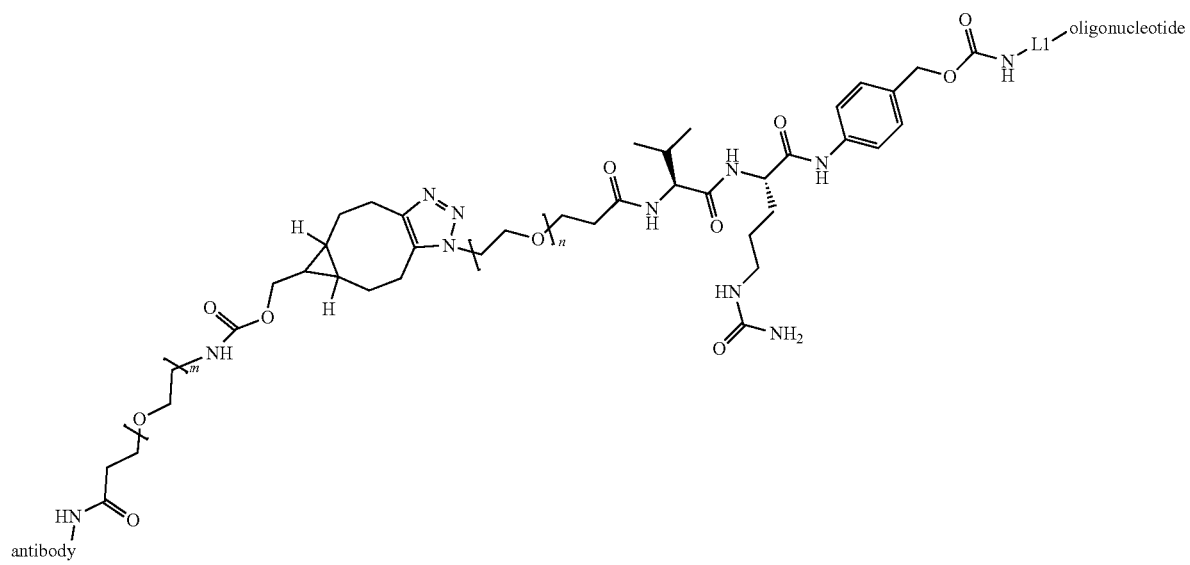

(D)

wherein n is 3 and m is 4. In some embodiments, the oligonucleotide is a DMD targeting oligonucleotide (e.g., an oligonucleotide listed in Table 14). In some embodiments, the oligonucleotide is an oligonucleotide provided by any one of SEQ ID NO: 437-1241, or complementary to any one of SEQ ID NO: 1242-2046.

In some embodiments, in any one of the examples of complexes described herein, L1 is any one of the spacers described herein.

In some embodiments, L1 is:

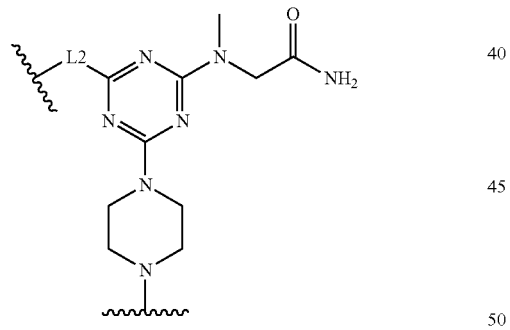

wherein the piperazine moiety links to the oligonucleotide, wherein L2 is

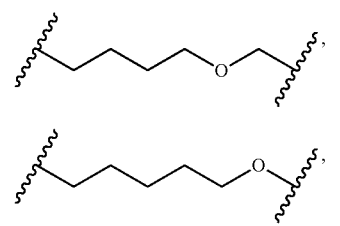

-continued

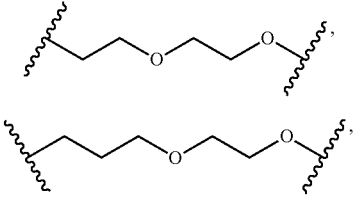

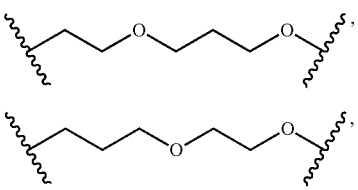

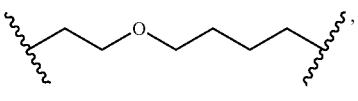

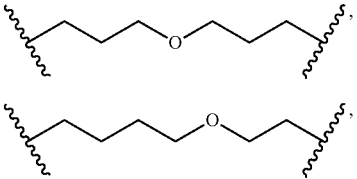

, or

-continued

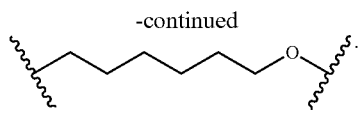

In some embodiments, L1 is:

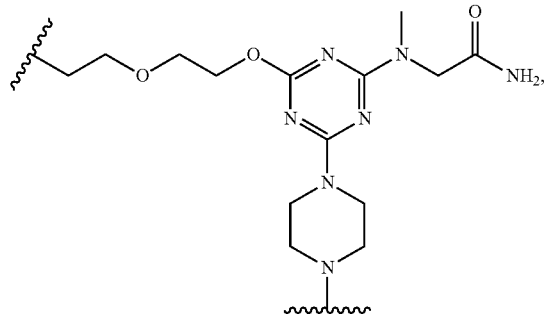 [SMILES: *CCOCCOc1nc(N(C)CC(N)=O)nc(N2CCN(*)CC2)n1]

wherein the piperazine moiety links to the oligonucleotide.

In some embodiments, L1 is

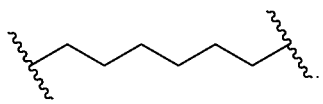 [SMILES: *CCCCCC*]

In some embodiments, L1 is linked to a 5' phosphate of the oligonucleotide.

In some embodiments, L1 is optional (e.g., need not be present).

III. Formulations

Complexes provided herein may be formulated in any suitable manner. Generally, complexes provided herein are formulated in a manner suitable for pharmaceutical use. For example, complexes can be delivered to a subject using a formulation that minimizes degradation, facilitates delivery and/or (e.g., and) uptake, or provides another beneficial property to the complexes in the formulation. In some embodiments, provided herein are compositions comprising complexes and pharmaceutically acceptable carriers. Such compositions can be suitably formulated such that when administered to a subject, either into the immediate environment of a target cell or systemically, a sufficient amount of the complexes enter target muscle cells. In some embodiments, complexes are formulated in buffer solutions such as phosphate-buffered saline solutions, liposomes, micellar structures, and capsids.

It should be appreciated that, in some embodiments, compositions may include separately one or more components of complexes provided herein (e.g., muscle-targeting agents, linkers, molecular payloads, or precursor molecules of any one of them).

In some embodiments, complexes are formulated in water or in an aqueous solution (e.g., water with pH adjustments). In some embodiments, complexes are formulated in basic buffered aqueous solutions (e.g., PBS). In some embodiments, formulations as disclosed herein comprise an excipient. In some embodiments, an excipient confers to a composition improved stability, improved absorption, improved solubility and/or (e.g., and) therapeutic enhancement of the active ingredient. In some embodiments, an excipient is a buffering agent (e.g., sodium citrate, sodium phosphate, a tris base, or sodium hydroxide) or a vehicle (e.g., a buffered solution, petrolatum, dimethyl sulfoxide, or mineral oil).

In some embodiments, a complex or component thereof (e.g., oligonucleotide or antibody) is lyophilized for extending its shelf-life and then made into a solution before use (e.g., administration to a subject). Accordingly, an excipient in a composition comprising a complex, or component thereof, described herein may be a lyoprotectant (e.g., mannitol, lactose, polyethylene glycol, or polyvinyl pyrolidone), or a collapse temperature modifier (e.g., dextran, ficoll, or gelatin).

In some embodiments, a pharmaceutical composition is formulated to be compatible with its intended route of administration. Examples of routes of administration include parenteral, e.g., intravenous, intradermal, subcutaneous, administration. Typically, the route of administration is intravenous or subcutaneous.

Pharmaceutical compositions suitable for injectable use include sterile aqueous solutions (where water soluble) or dispersions and sterile powders for the extemporaneous preparation of sterile injectable solutions or dispersions. The carrier can be a solvent or dispersion medium containing, for example, water, ethanol, polyol (for example, glycerol, propylene glycol, and liquid polyethylene glycol, and the like), and suitable mixtures thereof. In some embodiments, formulations include isotonic agents, for example, sugars, polyalcohols such as mannitol, sorbitol, and sodium chloride in the composition. Sterile injectable solutions can be prepared by incorporating the complexes in a required amount in a selected solvent with one or a combination of ingredients enumerated above, as required, followed by filtered sterilization.

In some embodiments, a composition may contain at least about 0.1% of the a complex, or component thereof, or more, although the percentage of the active ingredient(s) may be between about 1% and about 80% or more of the weight or volume of the total composition. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

IV. Methods of Use/Treatment

Complexes comprising a muscle-targeting agent covalently linked to a molecular payload as described herein are effective in treating a subject having a dystrophinopathy, e.g., Duchenne muscular dystrophy. In some embodiments, complexes comprise a molecular payload that is an oligonucleotide, e.g., an antisense oligonucleotide that facilitates exon skipping of an mRNA expressed from a mutated DMD allele.

In some embodiments, a subject may be a human subject, a non-human primate subject, a rodent subject, or any suitable mammalian subject. In some embodiments, a subject may have Duchenne muscular dystrophy or other dystrophinopathy. In some embodiments, a subject has a mutated DMD allele, which may optionally comprise at least one mutation in a DMD exon that causes a frameshift mutation and leads to improper RNA splicing/processing. In some embodiments, a subject is suffering from symptoms of a severe dystrophinopathy, e.g. muscle atrophy or muscle loss. In some embodiments, a subject has an asymptomatic increase in serum concentration of creatine phosphokinase (CK) and/or (e.g., and) muscle cramps with myoglobinuria. In some embodiments, a subject has a progressive muscle disease, such as Duchenne or Becker muscular dystrophy or DMD-associated dilated cardiomyopathy (DCM). In some embodiments, a subject is not suffering from symptoms of a dystrophinopathy.

An aspect of the disclosure includes a methods involving administering to a subject an effective amount of a complex as described herein. In some embodiments, an effective amount of a pharmaceutical composition that comprises a complex comprising a muscle-targeting agent covalently linked to a molecular payload can be administered to a subject in need of treatment. In some embodiments, a pharmaceutical composition comprising a complex as described herein may be administered by a suitable route, which may include intravenous administration, e.g., as a bolus or by continuous infusion over a period of time. In some embodiments, intravenous administration may be performed by intramuscular, intraperitoneal, intracerebrospinal, subcutaneous, intra-articular, intrasynovial, or intrathecal routes. In some embodiments, a pharmaceutical composition may be in solid form, aqueous form, or a liquid form. In some embodiments, an aqueous or liquid form may be nebulized or lyophilized. In some embodiments, a nebulized or lyophilized form may be reconstituted with an aqueous or liquid solution.

Compositions for intravenous administration may contain various carriers such as vegetable oils, dimethylactamide, dimethyformamide, ethyl lactate, ethyl carbonate, isopropyl myristate, ethanol, and polyols (glycerol, propylene glycol, liquid polyethylene glycol, and the like). For intravenous injection, water soluble antibodies can be administered by the drip method, whereby a pharmaceutical formulation containing the antibody and a physiologically acceptable excipients is infused. Physiologically acceptable excipients may include, for example, 5% dextrose, 0.9% saline, Ringer's solution or other suitable excipients. Intramuscular preparations, e.g., a sterile formulation of a suitable soluble salt form of the antibody, can be dissolved and administered in a pharmaceutical excipient such as Water-for-Injection, 0.9% saline, or 5% glucose solution.

In some embodiments, a pharmaceutical composition that comprises a complex comprising a muscle-targeting agent covalently linked to a molecular payload is administered via site-specific or local delivery techniques. Examples of these techniques include implantable depot sources of the complex, local delivery catheters, site specific carriers, direct injection, or direct application.

In some embodiments, a pharmaceutical composition that comprises a complex comprising a muscle-targeting agent covalently linked to a molecular payload is administered at an effective concentration that confers therapeutic effect on a subject. Effective amounts vary, as recognized by those skilled in the art, depending on the severity of the disease, unique characteristics of the subject being treated, e.g. age, physical conditions, health, or weight, the duration of the treatment, the nature of any concurrent therapies, the route of administration and related factors. These related factors are known to those in the art and may be addressed with no more than routine experimentation. In some embodiments, an effective concentration is the maximum dose that is considered to be safe for the patient. In some embodiments, an effective concentration will be the lowest possible concentration that provides maximum efficacy.

Empirical considerations, e.g. the half-life of the complex in a subject, generally will contribute to determination of the concentration of pharmaceutical composition that is used for treatment. The frequency of administration may be empirically determined and adjusted to maximize the efficacy of the treatment.

Generally, for administration of any of the complexes described herein, an initial candidate dosage may be about 1 to 100 mg/kg, or more, depending on the factors described above, e.g. safety or efficacy. In some embodiments, a treatment will be administered once. In some embodiments, a treatment will be administered daily, biweekly, weekly, bimonthly, monthly, or at any time interval that provide maximum efficacy while minimizing safety risks to the subject. Generally, the efficacy and the treatment and safety risks may be monitored throughout the course of treatment The efficacy of treatment may be assessed using any suitable methods. In some embodiments, the efficacy of treatment may be assessed by evaluation of observation of symptoms associated with a dystrophinopathy, e.g. muscle atrophy or muscle weakness, through measures of a subject's self-reported outcomes, e.g. mobility, self-care, usual activities, pain/discomfort, and anxiety/depression, or by quality-of-life indicators, e.g. lifespan.

In some embodiments, a pharmaceutical composition that comprises a complex comprising a muscle-targeting agent covalently linked to a molecular payload described herein is administered to a subject at an effective concentration sufficient to modulate activity or expression of a target gene by at least 10%, at least 20%, at least 30%, at least 40%, at least 50%, at least 60%, at least 70%, at least 80%, at least 90% or at least 95% relative to a control, e.g. baseline level of gene expression prior to treatment.

In some embodiments, a single dose or administration of a pharmaceutical composition that comprises a complex comprising a muscle-targeting agent covalently linked to a molecular payload described herein to a subject is sufficient to inhibit activity or expression of a target gene for at least 1-5, 1-10, 5-15, 10-20, 15-30, 20-40, 25-50, or more days. In some embodiments, a single dose or administration of a pharmaceutical composition that comprises a complex comprising a muscle-targeting agent covalently linked to a molecular payload described herein to a subject is sufficient to inhibit activity or expression of a target gene for at least 1, 2, 3, 4, 5, 6, 7, 8, 9, 10, 11, or 12 weeks. In some embodiments, a single dose or administration of a pharmaceutical composition that comprises a complex comprising a muscle-targeting agent covalently linked to a molecular payload described herein to a subject is sufficient to inhibit activity or expression of a target gene for at least 1, 2, 3, 4, 5, or 6 months.

In some embodiments, a pharmaceutical composition may comprise more than one complex comprising a muscle-targeting agent covalently linked to a molecular payload. In some embodiments, a pharmaceutical composition may further comprise any other suitable therapeutic agent for treatment of a subject, e.g. a human subject having a dystrophinopathy. In some embodiments, the other therapeutic agents may enhance or supplement the effectiveness of the complexes described herein. In some embodiments, the other therapeutic agents may function to treat a different symptom or disease than the complexes described herein.

EXAMPLES

Example 1: Targeting HPRT with Transfected Antisense Oligonucleotides

A siRNA that targets hypoxanthine phosphoribosyltransferase (HPRT) was tested in vitro for its ability to reduce expression levels of HPRT in an immortalized cell line. Briefly, Hepa 1-6 cells were transfected with either a control siRNA (siCTRL; 100 nM) or the siRNA that targets HPRT (siHPRT; 100 nM), formulated with lipofectamine 2000. HPRT expression levels were evaluated 48 hours following transfection. A control experiment was also performed in which vehicle (phosphate-buffered saline) was delivered to Hepa 1-6 cells in culture and the cells were maintained for 48 hours. As shown in FIG. 1, it was found that the HPRT siRNA reduced HPRT expression levels by about 90% compared with controls. Sequences of the siRNAs used are provided in Table 6.

TABLE 6

Sequences of siHPRT and siCTRL

| | Sequence* | SEQ ID NO: |
|---|---|---|
| siHPRT sense strand | 5'-UcCuAuGaCuGuAgAuUuUaU-(CH$_2$)$_6$NH$_2$-3' | 147 |
| siHPRT antisense strand | 5'-paUaAaAuCuAcAgUcAuAgGa sAsu-3' | 148 |
| siCTRL sense strand | 5'-UgUaAuAaCcAuAuCuAcCuU-(CH$_2$)$_6$NH$_2$-3' | 149 |
| siCTRL antisense strand | 5'-aAgGuAgAuAuGgUuAuUaCas Asa-3' | 150 |

*Lower case - 2'Ome ribose; Capital letter - 2'Fluoro ribose; p - phosphate linkage; s - phosphorothioate linkage Example 2: Targeting HPRT with a Muscle-Targeting Complex A muscle-targeting complex was generated comprising the HPRT siRNA used in Example 1 (siHPRT) covalently linked, via a non-cleavable N-gamma-maleimidobutyryl-oxysuccinimide ester (GMBS) linker, to RI7 217 anti-TfR1 Fab (DTX-A-002), an anti-transferrin receptor antibody.

Briefly, the GMBS linker was dissolved in dry DMSO and coupled to the 3' end of the sense strand of siHPRT through amide bond formation under aqueous conditions. Completion of the reaction was verified by Kaiser test. Excess linker and organic solvents were removed by gel permeation chromatography. The purified, maleimide functionalized sense strand of siHPRT was then coupled to DTX-A-002 antibody using a Michael addition reaction.

The product of the antibody coupling reaction was then subjected to size exclusion chromatography (SEC) purification. antiTfR-siHPRT complexes comprising one or two siHPRT molecules covalently attached to DTX-A-002 antibody were purified. Densitometry confirmed that the purified sample of complexes had an average siHPRT to antibody ratio of 1.46. SDS-PAGE analysis demonstrated that >90% of the purified sample of complexes comprised DTX-A-002 linked to either one or two siHPRT molecules.

Using the same methods as described above, a control IgG2a-siHPRT complex was generated comprising the HPRT siRNA used in Example 1 (siHPRT) covalently linked via the GMBS linker to an IgG2a (Fab) antibody (DTX-A-003). Densitometry confirmed that DTX-C-001 (the IgG2a-siHPRT complex) had an average siHPRT to antibody ratio of 1.46 and SDS-PAGE demonstrated that >90% of the purified sample of control complexes comprised DTX-A-003 linked to either one or two siHPRT molecules.

Figure 2:
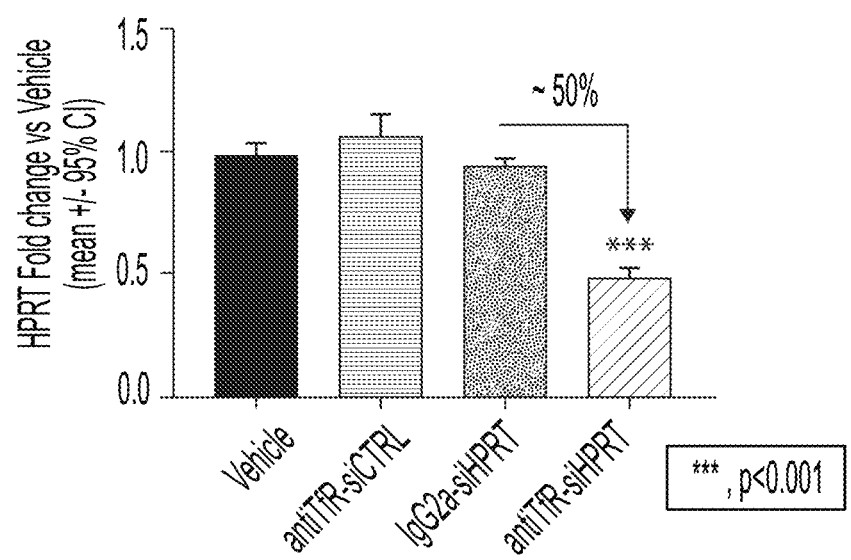
FIG. 2 depicts a non-limiting schematic showing the activity of a muscle targeting complex comprising an siRNA.

The antiTfR-siHPRT complex was then tested for cellular internalization and inhibition of HPRT in cellulo. Hepa 1-6 cells, which have relatively high expression levels of transferrin receptor, were incubated in the presence of vehicle (phosphate-buffered saline), IgG2a-siHPRT (100 nM), antiTfR-siCTRL (100 nM), or antiTfR-siHPRT (100 nM), for 72 hours. After the 72 hour incubation, the cells were isolated and assayed for expression levels of HPRT (FIG. 2). Cells treated with the antiTfR-siHPRT demonstrated a reduction in HPRT expression by about 50% relative to the cells treated with the vehicle control and to those treated with the IgG2a-siHPRT complex. Meanwhile, cells treated with either of the IgG2a-siHPRT or antiTfR-siCTRL had HPRT expression levels comparable to the vehicle control (no reduction in HPRT expression). These data indicate that the anti-transferrin receptor antibody of the antiTfR-siHPRT enabled cellular internalization of the complex, thereby allowing the siHPRT to inhibit expression of HPRT.

Example 3: Targeting HPRT in Mouse Muscle Tissues with a Muscle-Targeting Complex The muscle-targeting complex described in Example 2, antiTfR-siHPRT, was tested for inhibition of HPRT in mouse tissues. C57BL/6 wild-type mice were intravenously injected with a single dose of a vehicle control (phosphate-buffered saline); siHPRT (2 mg/kg of siRNA); IgG2a-siHPRT (2 mg/kg of siRNA, corresponding to 9 mg/kg antibody complex); or antiTfR-siHPRT (2 mg/kg of siRNA, corresponding to 9 mg/kg antibody complex. Each experimental condition was replicated in four individual C57BL/6 wild-type mice. Following a three-day period after injection, the mice were euthanized and segmented into isolated tissue types. Individual tissue samples were subsequently assayed for expression levels of HPRT (FIGS. 3A-3B and 4A-4E).

Figure 3A:
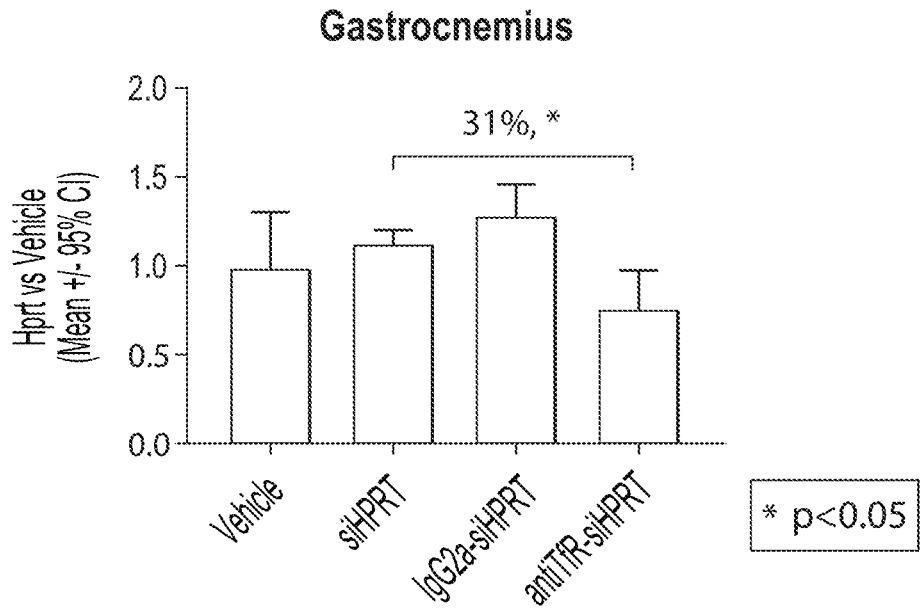
FIGS. 3A-3B depict non-limiting schematics showing the activity of a muscle targeting complex comprising an siRNA in mouse muscle tissues (gastrocnemius and heart) in vivo, relative to control non-targeting complex comprising the same siRNA. (N=4 C57BL/6 WT mice)
Figure 3B:
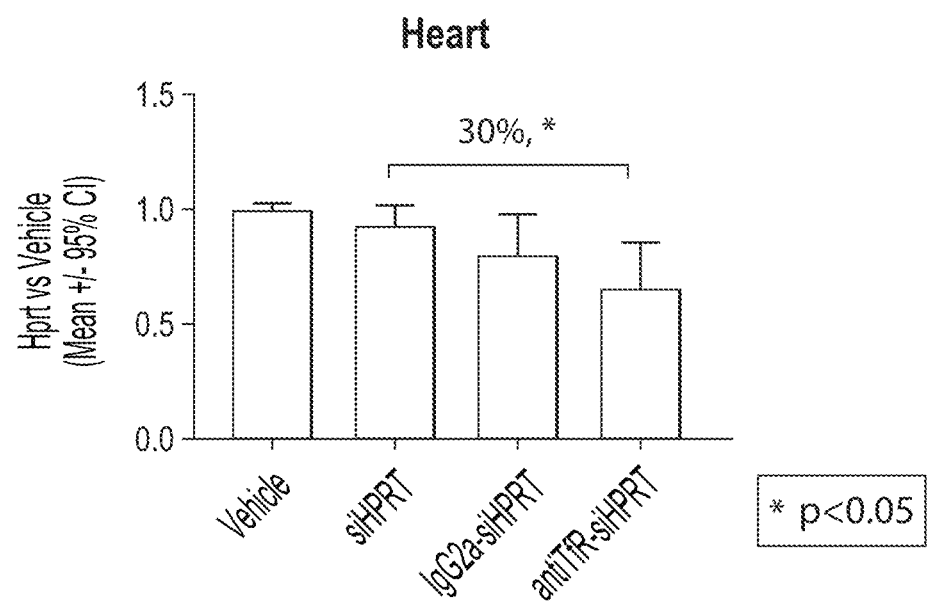
Figure 4A:
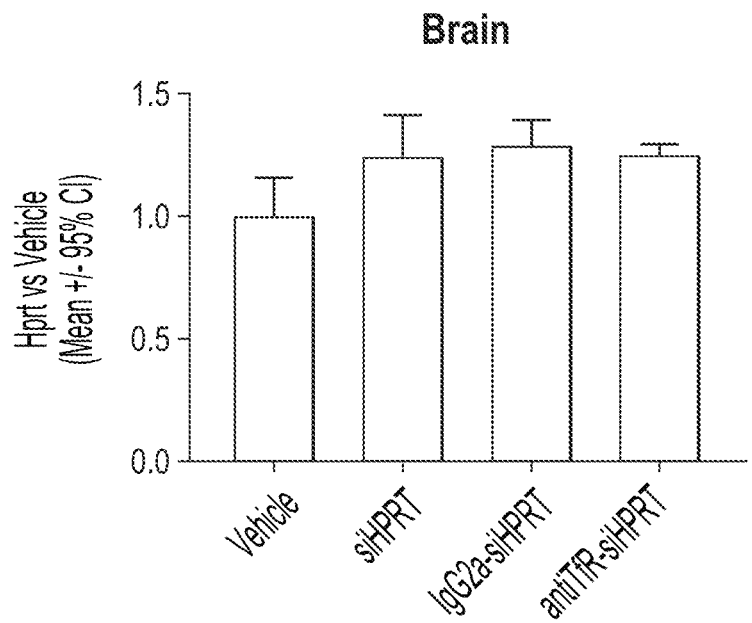
FIGS. 4A-4E depict non-limiting schematics showing the tissue selectivity of a muscle targeting complex comprising an siRNA.
Figure 4B:
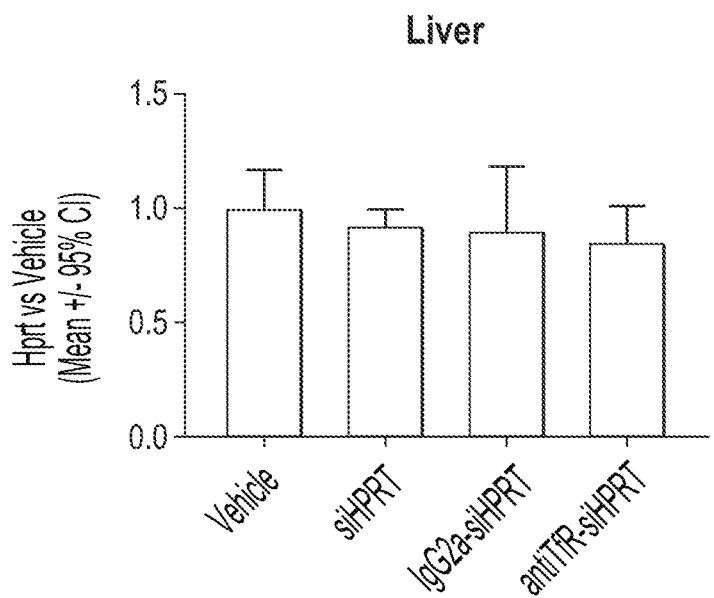
Figure 4C:
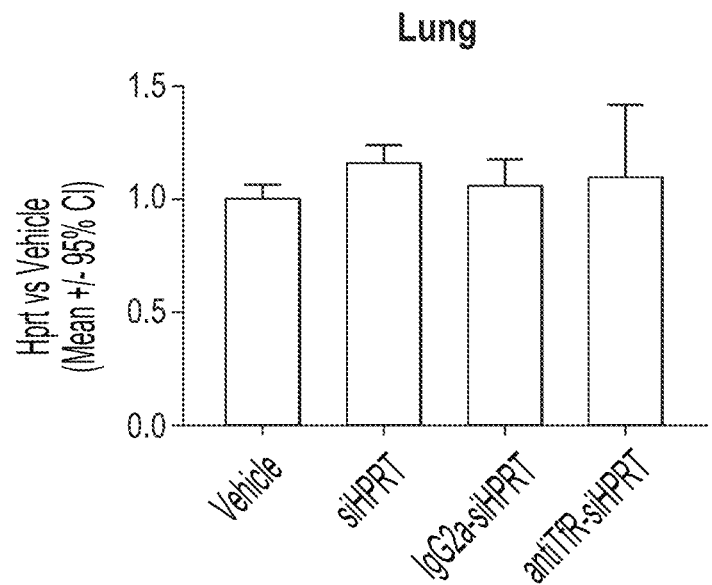
Figure 4D:
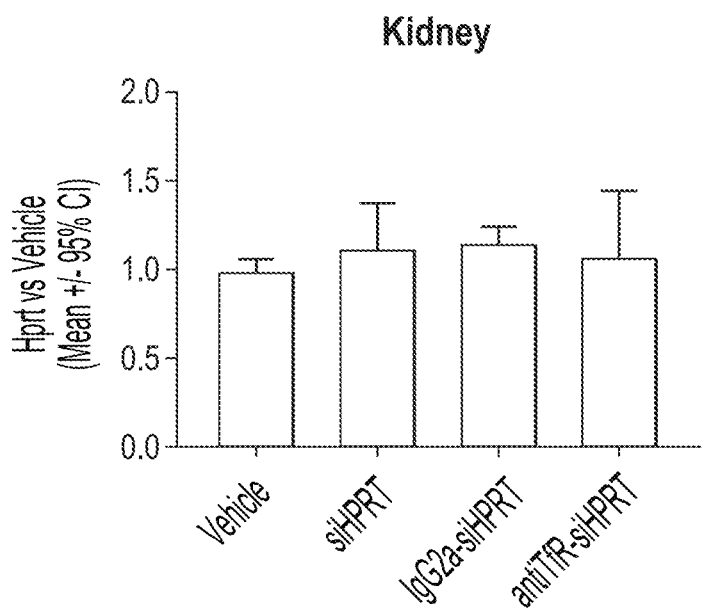
Figure 4E:
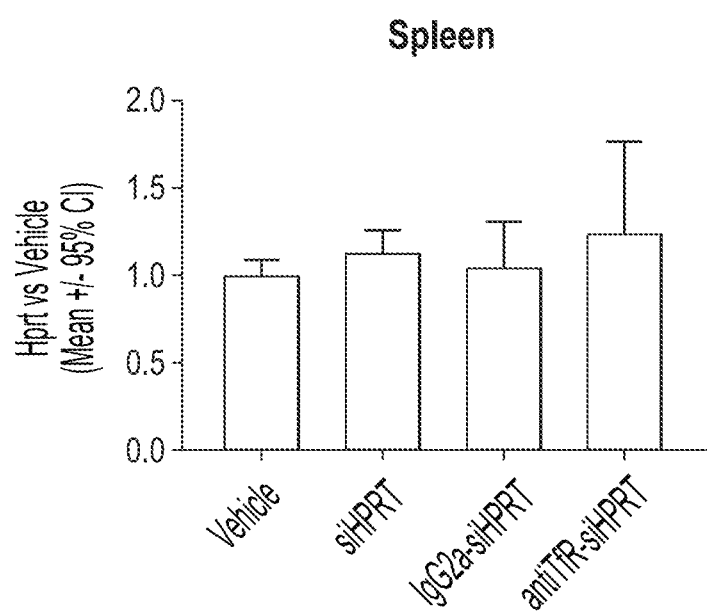

Mice treated with the antiTfR-siHPRT complex demonstrated a reduction in HPRT expression in gastrocnemius (31% reduction; p<0.05) and heart (30% reduction; p<0.05), relative to the mice treated with the siHPRT control (FIGS. 3A-3B). Meanwhile, the mice treated with the IgG2a-siHPRT complex had HPRT expression levels comparable to the siHPRT control (little or no reduction in HPRT expression) for all assayed muscle tissue types.

Mice treated with the antiTfR-siHPRT complex demonstrated no change in HPRT expression in non-muscle tissues such as brain, liver, lung, kidney, and spleen tissues (FIGS. 4A-4E). These data indicate that the anti-transferrin receptor antibody of the antiTfR-siHPRT complex enabled cellular internalization of the complex into muscle-specific tissues in an in vivo mouse model, thereby allowing the siHPRT to inhibit expression of HPRT. These data further demonstrate that the antiTfR-oligonucleotide complexes of the current disclosure are capable of specifically targeting muscle tissues.

Example 4: Targeting DMD with a Muscle-Targeting Complex

A muscle-targeting complex is generated comprising an antisense oligonucleotide that targets a mutant allele of DMD (DMD ASO), for exon skipping, e.g., an oligonucleotide having a sequence as disclosed in Table 14, covalently linked, via a cathepsin cleavable linker, to DTX-A-002 (RI7 217 (Fab)), an anti-transferrin receptor antibody.

Briefly, purified Val-Cit-linker-DMD ASO is coupled to a functionalized antibody fragment (e.g, RI7 217 (Fab) or 15G11 (Fab)) generated through modifying E-amine on lysine of the antibody.

The product of the antibody coupling reaction is then subjected to hydrophobic interaction chromatography (HIC-HPLC) to purify the muscle-targeting complex. Densitometry and SDS-PAGE analysis of the purified complex allow for determination of the average ratio of ASO-to-antibody and total purity, respectively.

Using the same methods as described above, a control complex is generated comprising DMD ASO covalently linked via a Val-Cit linker to an IgG2a (Fab) antibody. The purified muscle-targeting complex comprising DTX-A-002 covalently linked to DMD ASO is then tested for cellular internalization and modulation of DMD exon skipping. Disease-relevant muscle cells that have relatively high expression levels of transferrin receptor, are incubated in the presence of vehicle control (saline), muscle-targeting complex (100 nM), or control complex (100 nM) for 72 hours. After the 72 hour incubation, the cells are isolated and assayed for expression levels of DMD.

Example 5: Targeting DMD with a Muscle-Targeting Complex

A muscle-targeting complex (DTX-C-042) was generated comprising an PMO ASO that targets exon 23 of DMD covalently linked to DTX-A-002 (RI7 217 (Fab)), an anti-transferrin receptor antibody.

Briefly, a Bicyclo[6.1.0]nonyne-PEG3-L-valine-L-citrulline-pentafluorophenyl ester (BCN-PEG3-Val-Cit-PFP) linker molecule was coupled to $NH_2$—$C_6$-(exon-23 PMO) using an amide coupling reaction. Excess linker and organic solvents were removed by gel permeation chromatography. The purified Val-Cit-linker-(exon-23 PMO) was then coupled to an azide functionalized anti-transferrin receptor antibody (DTX-A-002) generated through modifying ε-amine on lysine with Azide-PEG4-PFP.

The product of the antibody coupling reaction was then purified and densitometry confirmed that this sample of DTX-C-042 complexes had an average ASO to antibody ratio of 1.9.

The PMO ASO that targets exon 23 of DMD used in this Example comprises a sequence consisting of GGCCAAAC-CUCGGCUUACCUGAAAU (SEQ ID NO: 171).

DTX-C-042 was tested for its ability to induce exon skipping of exon 23 of the dystrophin gene, and to subsequently increase expression of dystrophin protein in targeted muscles relevant to DMD in vivo. mdx mice, a DMD mouse model, were intravenously injected with a single dose of a vehicle control (saline); DTX-C-042 complex at a dose of 10 mg/kg ASO; DTX-C-042 complex at a dose of 20 mg/kg ASO; or DTX-C-042 complex at a dose of 30 mg/kg ASO. Each experimental condition was replicated in four mdx mice. Four wild-type mice were also dosed with vehicle control (saline) as a control experiment.

Figure 5:
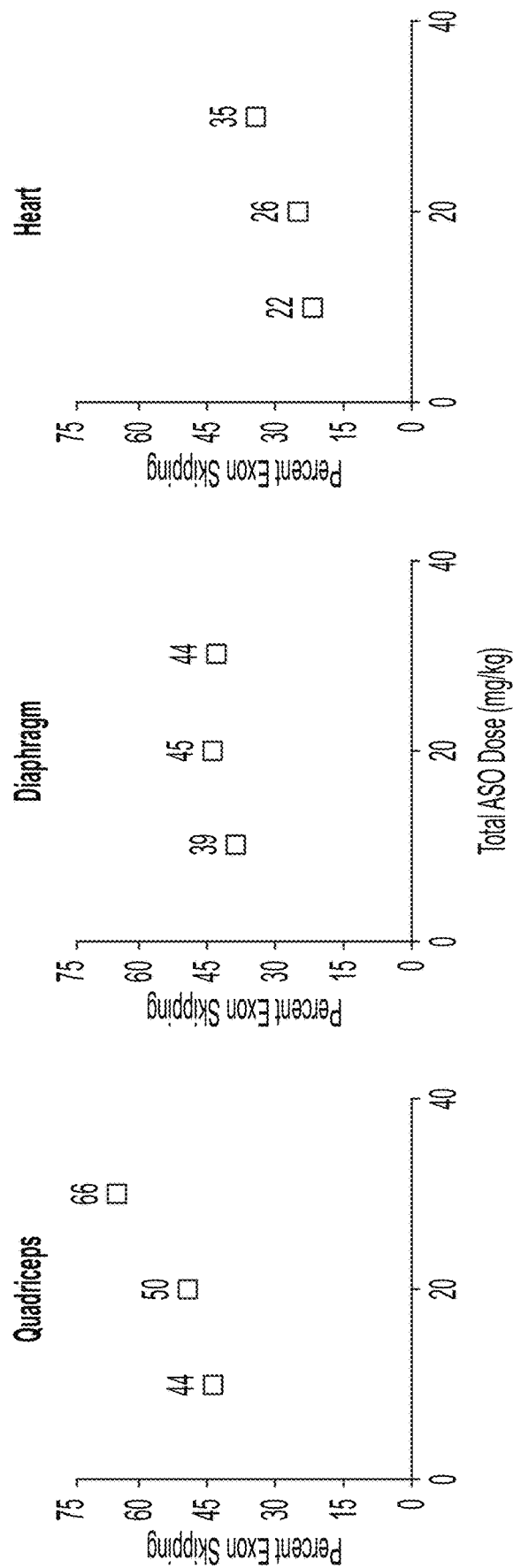
FIG. 5 depicts a non-limiting schematic showing the ability of an anti-transferrin receptor muscle targeting complex comprising an exon-23 skipping phosphorodiamidate morpholino oligomer (PMO) to dose-dependently enhance exon skipping in muscle tissues of a mdx mouse model.
Figure 6A:
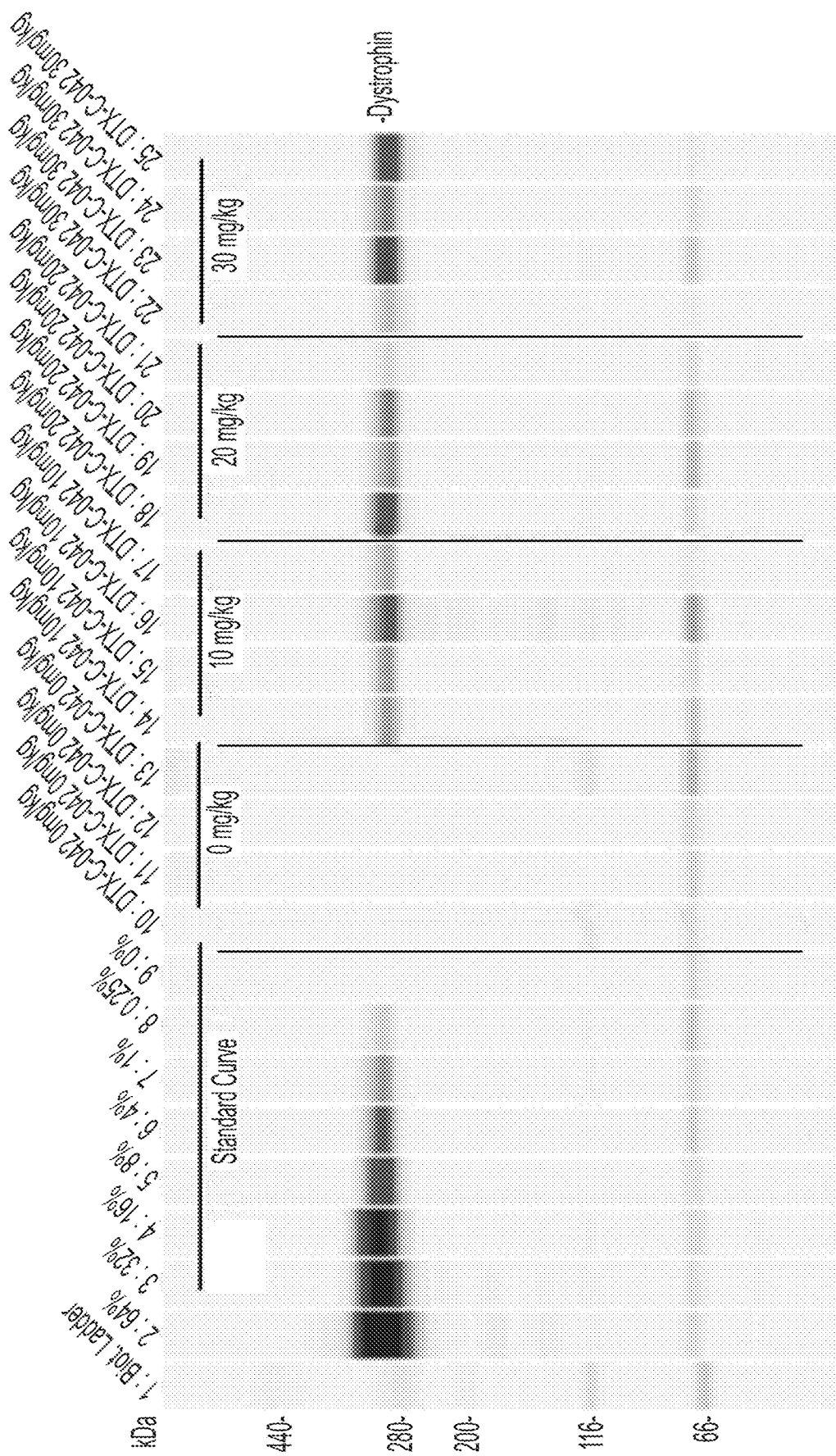
FIGS. 6A-6B depict non-limiting schematics showing the ability of an anti-transferrin receptor muscle targeting complex comprising an exon-23 skipping PMO to dose-dependently increase dystrophin in skeletal muscle (quadriceps) of a mdx mouse model.
Figure 6B:
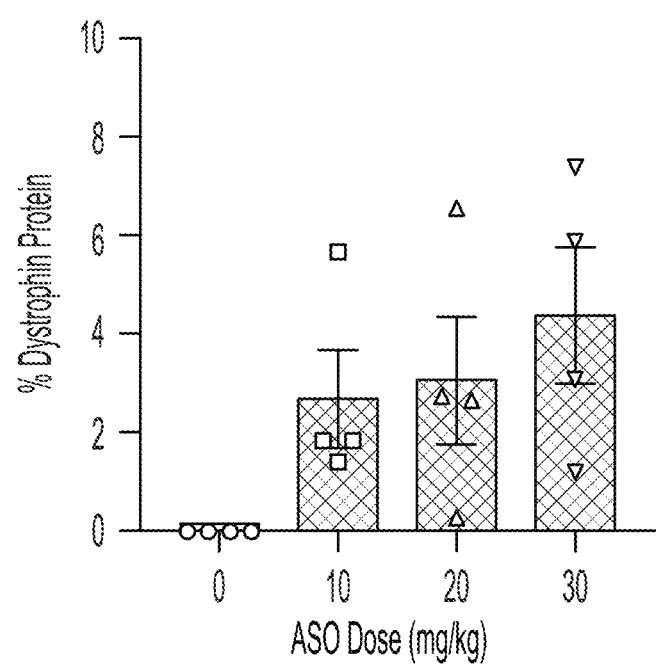

Fourteen days after treatment, mice were euthanized and targeted muscle tissues were collected. Individual muscle tissue samples were subsequently assayed for percent skipping of exon 23 of the dystrophin gene (FIG. 5). Additionally, dystrophin protein levels in targeted muscles were also quantified (quantification of dystrophin in quadriceps is shown in FIGS. 6A-6B).

Mice treated with the DTX-C-042 complex demonstrated a dose-dependent increase in the percent exon skipping of exon 23 in quadriceps, diaphragm, and heart muscles. Mice treated with the DTX-C-042 complex also demonstrated a dose-dependent increase in the expression of dystrophin protein in the quadriceps, with an average of >4% dystrophin protein in mice treated with 30 mg/kg ASO equivalent of DTX-C-042.

These data demonstrate that the anti-transferrin receptor antibody of the antibody-ASO complex enables cellular internalization of the complex into muscle-specific tissues in an in vivo mdx mouse model, thereby allowing the exon 23 PMO ASO to induce exon skipping of exon 23 of DMD. These data further demonstrate that the antibody-ASO complex is capable of specifically targeting muscle tissues.

Example 6: Targeting DMD with a Muscle-Targeting Complex to Demonstrate Functional Benefit in Mdx Mouse Model Mdx mice (DMD mouse model; diseased mice) were intravenously injected with a single dose of a vehicle control (saline); the MDX-ASO (naked exon 23 skipping PMO ASO, 30 mg/kg); or the DTX-C-042 complex as described in Example 5 (anti-transferrin receptor antibody RI7 217 Fab linked to exon 23 skipping PMO, 30 mg/kg ASO equivalent). Each experimental condition was replicated in five mdx mice. Five wild-type mice (healthy mice) were also dosed with vehicle control (saline).

Figure 7A:
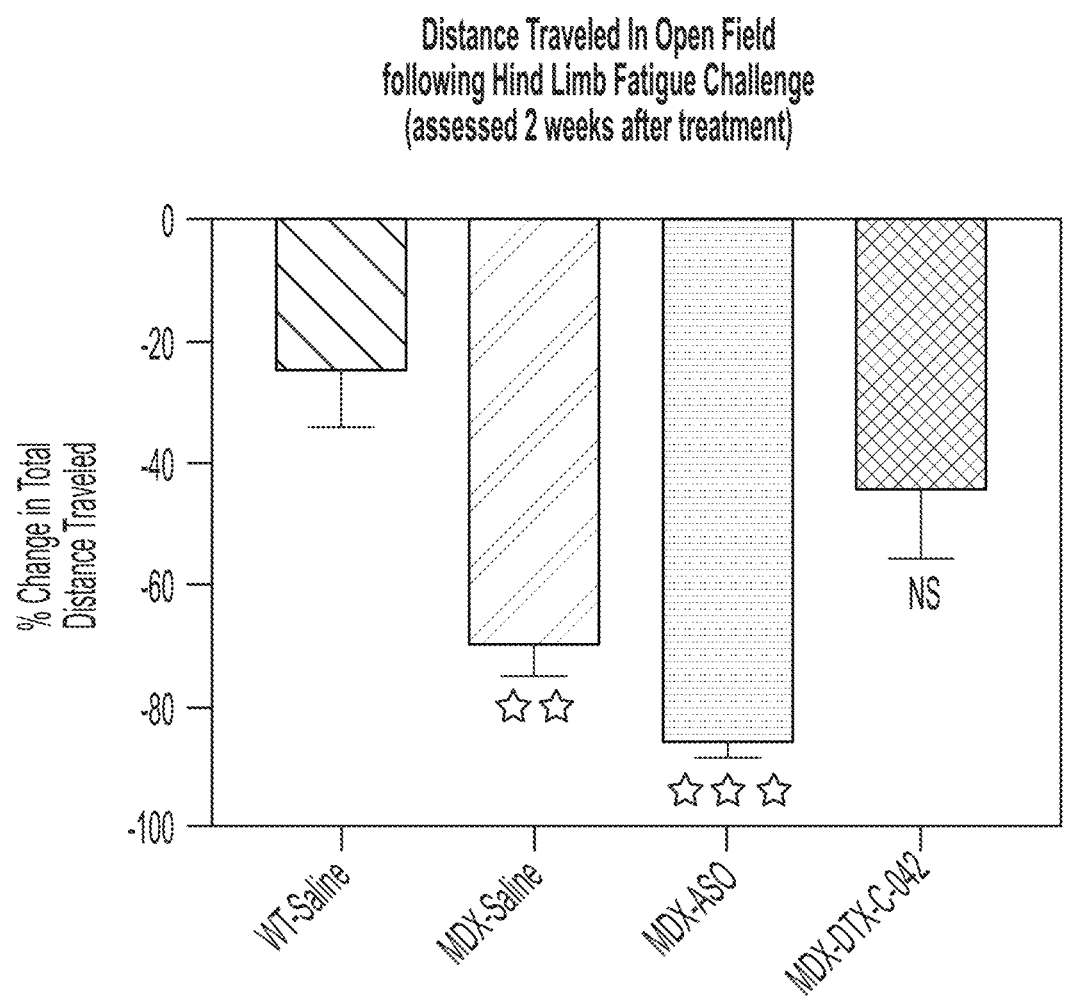
FIGS. 7A-7E depict non-limiting schematics showing the ability of an anti-transferrin receptor muscle targeting complex comprising an exon-23 skipping PMO to improve functional performance (FIGS. 7A, 7B, 7C, and 7D) and reduce creatine kinase levels (FIG. 7E) in an mdx mouse model. (p<0.01; *p<0.001; ****; p<0.0001; NS not significant)
Figure 7B:
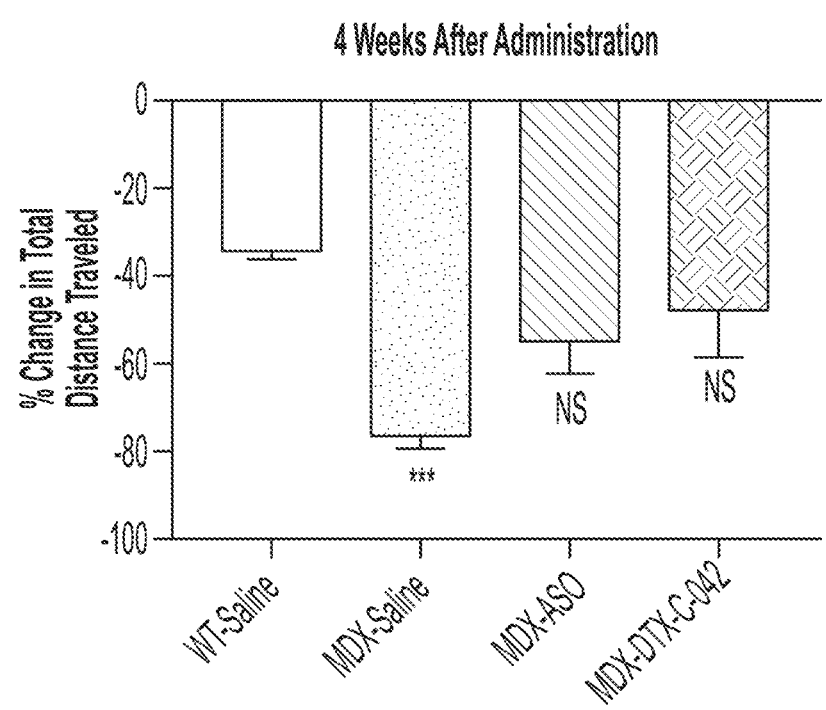

Two and four weeks after injection, the functional activity of all treated mice was determined using an open field chamber experiment. The experiment involved three consecutive stages: (1) a 10-minute period during which each mouse was placed into an open field chamber; (2) a 10-minute period during which each mouse was subjected to a hind limb fatigue challenge; and (3) a 10-minute period during which each mouse was placed into an open field chamber. The total horizontal distances traveled during stages (1) and (3) were collected. The percent change in the total distance traveled between the first and second tests. As shown in FIG. 7A, at the two week timepoint, the wild-type mice treated with saline traveled an average of about 20% less during stage (3) relative to stage (1); the mdx mice treated with saline traveled an average of about 70% less during stage (3) relative to stage (1); the mdx mice treated with MDX-ASO traveled an average of about 85% less during stage (3) relative to stage (1); and the mdx mice treated with DTX-C-042 traveled an average of about 40% less during stage (3) relative to stage (1). When compared to wild-type mice treated with saline, mdx mice treated with saline performed significantly worse (as indicated by a significant decrease in distance traveled in stage (3) relative to stage (1)). This observation is consistent with the impaired motor function experienced by DMD patients. mdx mice treated with naked MDX-ASO showed the same compromised functional performance as those treated with vehicle. In contrast, the performance of mdx mice treated with DTX-C-042 was not statistically different from vehicle treated wild-type mice. As shown in FIG. 7B, at the four week timepoint, the wild-type mice treated with saline traveled an average of about 35% less during stage (3) relative to stage (1); the mdx mice treated with saline traveled an average of about 80% less during stage (3) relative to stage (1); the mdx mice treated with MDX-ASO traveled an average of about 55% less during stage (3) relative to stage (1); and the mdx mice treated with DTX-C-042 traveled an average of about 50% less during stage (3) relative to stage (1).

Figure 7C:
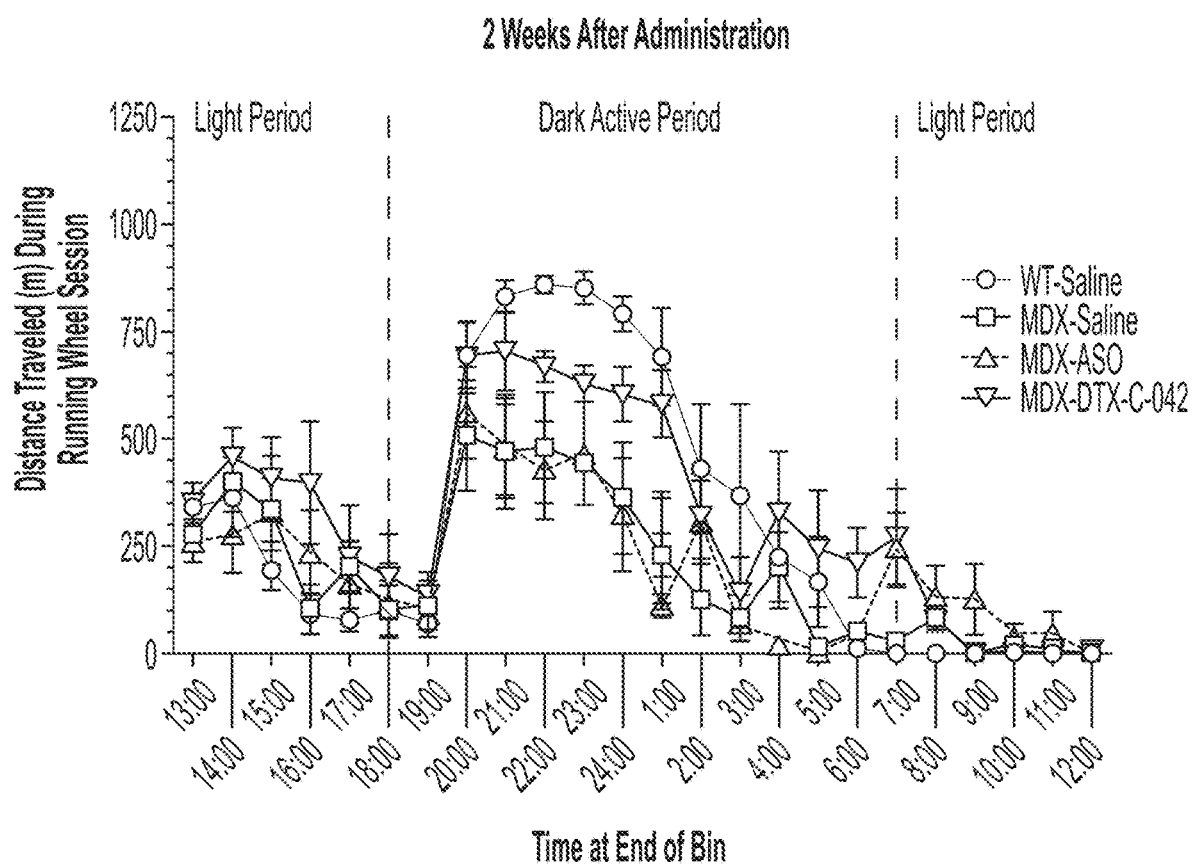
Figure 7D:
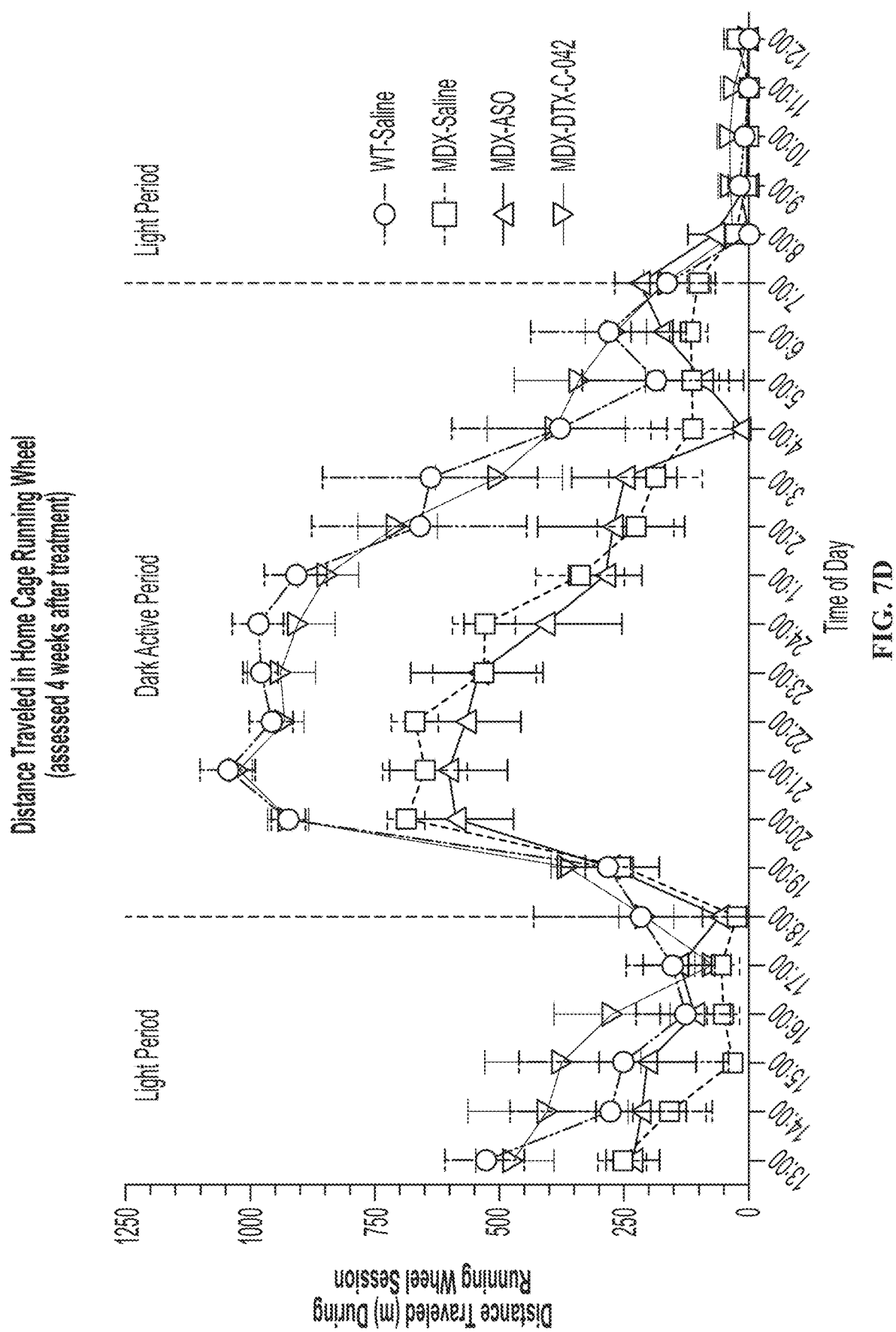

Two and four weeks after injection, the activity of all treated mice was determined using a cage running wheel test. Each mouse was individually placed into cages with a running wheel for a 24-hour period. The 24-hour period involved five hours of light on followed by thirteen hours of darkness, and ending with six hours of light. The total distance traveled (in meters, m) by each mouse on the running wheel was continuously collected throughout the 24-hour period and subsequently binned into discrete one-hour increments. As shown in FIG. 7C, at the two week timepoint, the distance traveled by the mdx mice treated with DTX-C-042 was higher than the distance traveled by the mdx mice treated with MDX-ASO or with saline, and approached the distance traveled by the wild-type mice at certain times. As shown in FIG. 7D, at the four week timepoint, the distance traveled by the mdx mice treated with DTX-C-042 complex closely mirrored the total distance traveled by the wild-type mice treated with saline during the dark period (i.e., when mice are active). This is in contrast to the mdx mice treated with either saline or MDX-ASO, which traveled considerably shorter distances during the dark period.

Figure 7E:
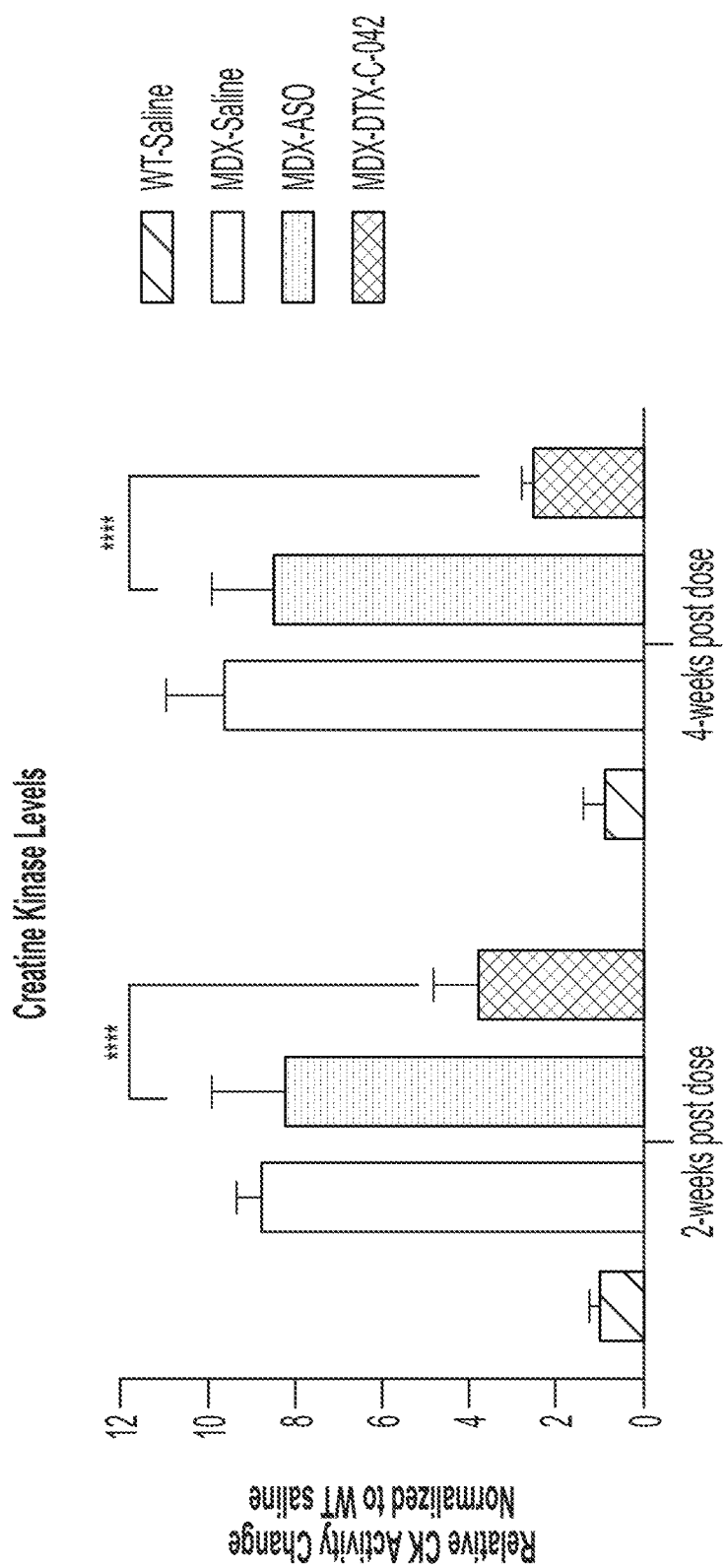

All mice in this Example were further tested for creatine kinase activity levels two weeks and four weeks after injection. Wild-type mice do not secrete large amounts of creatine kinase from muscle tissues. Conversely, mdx mice (having diseased muscle tissues) do secrete high levels of creatine kinase, which can be observed by determination of creatine kinase enzymatic activities. As shown in FIG. 7E, the mdx mice that were treated with saline had approximately 9- and 10-fold more creatine kinase enzymatic activity relative to wild-type mice treated with saline after two and four weeks, respectively. Dosing with naked ASO provided no significant benefit to the mdx mice. However, dosing mdx mice with DTX-C-042 complex did provide a statistically significant reduction in levels of creatine kinase activity after both two and four weeks.

These surprising results show that the antibody-ASO complex is capable of providing functional benefits to mice suffering from a DMD phenotype (mdx mice), such that these mice have phenotypic indicators resembling healthy (wild-type) mice. The performance of the antibody-ASO complex relative to the naked PMO (MDX-ASO) demonstrates that the anti-transferrin receptor antibody of the antibody-ASO complex is responsible for providing the functional benefits shown in this Example.

Example 7: Binding Affinity of Selected Anti-TfR1 Antibodies to Human TfR1

Selected anti-TfR1 antibodies were tested for their binding affinity to human TfR1 for measurement of Ka (association rate constant), Kd (dissociation rate constant), and $K_D$ (affinity). Two known anti-TfR1 antibodies were used as control, 15G11 and OKT9. The binding experiment was performed on Carterra LSA at 25° C. An anti-mouse IgG and anti-human IgG antibody "lawn" was prepared on a HC30M chip by amine coupling. The IgGs were captured on the chip. Dilution series of hTfR1, cyTfR1, and hTfR2 were injected to the chip for binding (starting from 1000 nM, 1:3 dilution, 8 concentrations).

Binding data were referenced by subtracting the responses from a buffer analyte injection and globally fitting to a 1:1 Langmuir binding model for estimate of Ka (association rate constant), Kd (dissociation rate constant), and $K_D$ (affinity) using the Carterra™ Kinetics software. 5-6 concentrations were used for curve fitting.

The result showed that the mouse mAbs demonstrated binding to hTfR1 with $K_D$ values ranging from 13 pM to 50 nM. A majority of the mouse mAbs had $K_D$ values in the single digit nanomolar to sub-nanomolar range. The tested mouse mAbs showed cross-reactive binding to cyTfR1 with $K_D$ values ranging from 16 pM to 22 nM.

Ka, Kd, and $K_D$ values of anti-TfR1 antibodies are provided in Table 7.

TABLE 7

Ka, Kd, and $K_D$ values of anti-TfR1 antibodies

| Name | $K_D$ (M) | Ka (M) | Kd (M) |
|---|---|---|---|
| ctrl-15G11 | 2.83E−10 | 3.70E+05 | 1.04E−04 |
| ctrl-OKT9 mIgG | 5.36E−10 | 7.74E+05 | 4.15E−04 |
| 3-A04 | 4.36E−10 | 4.47E+05 | 1.95E−04 |
| 3-M12 | 7.68E−10 | 1.66E+05 | 1.27E−04 |
| 5-H12 | 2.08E−07 | 6.67E+04 | 1.39E−02 |

Example 8: Conjugation of Anti-TfR1 Antibodies with Oligonucleotides

Complexes containing an anti-TfR1 antibody covalently conjugated to a tool oligo (ASO300) were generated. First, Fab fragments of anti-TfR antibody clones 3-A4, 3-M12, and 5-H12 were prepared by cutting the mouse monoclonal antibodies with an enzyme in or below the hinge region of the full IgG followed by partial reduction. The Fabs were confirmed to be comparable to mAbs in avidity or affinity.

Muscle-targeting complexes were generated by covalently linking the anti-TfR mAbs to the ASO300 via a cathepsin cleavable linker. Briefly, a Bicyclo[6.1.0]nonyne-PEG3-L-valine-L-citrulline-pentafluorophenyl ester (BCN-PEG3-Val-Cit-PFP) linker molecule was coupled to the ASO300 through a carbamate bond. Excess linker and organic solvents were removed by tangential flow filtration (TFF). The purified Val-Cit-linker-ASO was then coupled to an azide functionalized anti-transferrin receptor antibody generated through modifying s-amine on lysine with Azide-PEG4-PFP. A positive control muscle-targeting complex was also generated using 15G11.

The product of the antibody coupling reaction was then subjected to two purification methods to remove free antibody and free payload. Concentrations of the conjugates were determined by either Nanodrop A280 or BCA protein assay (for antibody) and Quant-It Ribogreen assay (for payload). Corresponding drug-antibody ratios (DARs) were calculated. DARs ranged between 0.8 and 2.0, and were standardized so that all samples receive equal amounts of payload.

The purified complexes were then tested for cellular internalization and inhibition of the target gene, DMPK. Non-human primate (NHP) or DM1 (donated by DM1 patients) cells were grown in 96-well plates and differentiated into myotubes for 7 days. Cells were then treated with escalating concentrations (0.5 nM, 5 nM, 50 nM) of each complex for 72 hours. Cells were harvested, RNA was isolated, and reverse transcription was performed to generate cDNA. qPCR was performed using TaqMan kits specific for Ppib (control) and DMPK on the QuantStudio 7. The relative amounts of remaining DMPK transcript in treated vs non-treated cells were calculated and the results are shown in Table 12.

The results demonstrated that the anti-TfR1 antibodies are able to target muscle cells, be internalized by the muscle cells with the molecular payload (the tool oligo ASO300), and that the molecular payload is able to target and knockdown the target gene (DMPK). Knockdown activity of a complex comprising the anti-TfR1 antibody conjugated to a molecular payload (e.g., an oligonucleotide) targeting DMD may be tested using the same assay as described herein, e.g., by using any one of the oligonucleotides described in Table 14, provided by any one of SEQ ID NO: 437-1241, or complementary to any one of SEQ ID NO: 1242-2046.

TABLE 12

Binding Affinity of anti-TfR1 Antibodies and Efficacy of Conjugates

| Clone Name | huTfR1 Avg $K_D$ (M) (antibody alone) | cyTfR1 Avg $K_D$ (M) (antibody alone) | % knockdown of DMPK in NHP cells using Antibody-DMPK ASO conjugate | % knockdown of DMPK in cells from human DM1 patients using Antibody-DMPK ASO conjugate |
|---|---|---|---|---|
| 15G11 (control) | 8.0E−10 | 1.0E−09 | 36 | 46 |
| 3-A4 | 4.36E−10 | 2.32E−09 | 77 | 70 |
| 3-M12 | 7.68E−10 | 5.18E−09 | 77 | 52 |
| 5-H12 | 2.02316E−07 | 1.20E−08 | 88 | 57 |

Interestingly, the DMPK knockdown results showed a lack of correlation between the binding affinity of the anti-TfR to transferrin receptor and efficacy in delivering a DMPK ASO to cells for DMPK knockdown. Surprisingly, the anti-TfR antibodies provided herein (e.g., at least 3-A4, 3-M12, and 5-H12) demonstrated superior activity in delivering a payload (e.g., DMPK ASO) to the target cells and achieving the biological effect of the molecular payload (e.g., DMPK knockdown) in either cyno cells or human DM1 patient cells, compared to the control antibody 15G11, despite the comparable binding affinity (or, in certain instances, such as 5-H12, lower binding affinity) to human or cyno transferrin receptor between these antibodies and the control antibody 15G11.

Top attributes such as high huTfR1 affinity, >50% knockdown of DMPK in NHP and DM1 patient cell line, identified epitope binding with 3 unique sequences, low/no predicted PTM sites, and good expression and conjugation efficiency led to the selection of the top 3 clones for humanization, 3-A4, 3-M12, and 5-H12.

Example 9: Humanized Anti-TfR1 Antibodies

The anti-TfR antibodies shown in Table 2 were subjected to humanization and mutagenesis to reduce manufacturability liabilities. The humanized variants were screened and tested for their binding properties and biological actives. Humanized variants of anti-TfR1 heavy and light chain variable regions (5 variants each) were designed using Composite Human Technology. Genes encoding Fabs having these heavy and light chain variable regions were synthesized, and vectors were constructed to express each humanized heavy and light chain variant. Subsequently, each vector was expressed on a small scale and the resultant humanized anti-TfR1 Fabs were analyzed. Humanized Fabs were selected for further testing based upon several criteria including Biocore assays of antibody affinity for the target antigen, relative expression, percent homology to human germline sequence, and the number of MHC class II predicted T cell epitopes (determined using iTope™ MCH class II in silico analysis). Potential liabilities were identified within the parental sequence of some antibodies by introducing amino acid substitutions in the heavy chain and light chain variable regions. These substitutions were chosen based on relative expression levels, iTope™ score and relative $K_D$ from Biacore single cycle kinetics analysis. The humanized variants were tested and variants were selected initially based upon affinity for the target antigen. Subsequently, the selected humanized Fabs were further screened based on a series of biophysical assessments of stability and susceptibility to aggregation and degradation of each analyzed variant, shown in Table 16 and Table 17. The selected Fabs were analyzed for their properties binding to TfR1 by kinetic analysis. The results of these analyses are shown in Table 13. For conjugates shown in Table 16 and Table 17, the selected humanized Fabs were conjugated to a DMPK-targeting oligonucleotide ASO300. The selected Fabs are thermally stable, as indicated by the comparable binding affinity to human and cyno TfR1 after been exposed to high temperature (40° C.) for 9 days, compared to before the exposure (see Table 13).

TABLE 16

Biophysical assessment data for humanized anti-TfR Fabs

| | Variant | | | | |
|---|---|---|---|---|---|
| Criteria | 3M12 (VH3/Vk2) | 3M12 (VH3/Vk3) | 3M12 (VH4/Vk2) | 3M12 (VH4/Vk3) | 3A4 (VH3-N54T/Vk4) |
| Binding Affinity (Biacore d0) | 395 pM | 345 pM | 396 pM | 341 pM | 3.09 nM |
| Binding Affinity (Biacore d25) | 567 pM | 515 pM | 510 pM | 486 pM | 3.01 nM |
| Fab binding affinity ELISA (human/cyno TfR1) | 0.8 nM/9.9 nM | 0.6 nM/4.7 nM | 0.4 nM/1.4 nM | 0.5 nM/2.2 nM | 2.6 nM/156 nM* |

TABLE 16-continued

Biophysical assessment data for humanized anti-TfR Fabs

| | | | | | |
|---|---|---|---|---|---|
| Conjugate binding affinity ELISA (human/cyno TfR1) | 2.2 nM/2.9 nM | N/A | N/A | 1.7 nM/2.1 nM | 2.8 nM/4.7 nM |

. . .

| | Variant | | | | |
|---|---|---|---|---|---|
| Criteria | 3A4 (VH3-N54S/Vk4) | 3A4 (VH3/Vk4) | 5H12 (VH5-C33Y/Vk3) | 5H12 (VH5-C33D/Vk4) | 5H12 (VH4-C33Y/Vk4) |
| Binding Affinity (Biacore d0) | 1.34 nM | 1.5 nM | 627 pM | 991 pM | 626 pM |
| Binding Affinity (Biacore d25) | 1.39 nM | 1.35 nM | 1.07 nM | 3.01 nM | 1.33 nM |
| Fab binding affinity ELISA (human/cyno TfR1) | 1.6 nM/398 nM* | 1.5 nM/122 nM* | 6.3 nM/2.1 nM | 6.0 nM/3.5 nM | 2.8 nM/3.3 nM |
| Conjugate binding affinity ELISA (human/cyno TfR1) | 2.9 nM/7.8 nM | 2.8 nM/7.6 nM | 33.4 nM/2.3 nM | 110 nM/10.2 nM | 23.7 nM/3.3 nM |

*Regains cyno binding after conjugation;

TABLE 17

Thermal Stability for humanized anti-TfR Fabs and conjugates

| | Variant | | | | |
|---|---|---|---|---|---|
| Criteria | 3M12 (VH3/Vk2) | 3M12 (VH3/Vk3) | 3M12 (VH4/Vk2) | 3M12 (VH4/Vk3) | 3A4 (VH3-N54T/Vk4) |
| Binding affinity hTfR1 d0 (nM) | 0.8 | 0.6 | 0.4 | 0.5 | 2.6 |
| Binding affinity hTfR1 d9 (nM) | 0.98 | 1.49 | 0.50 | 0.28 | 0.40 |
| Binding affinity cyno TfR1 d0 (nM) | 9.9 | 4.7 | 1.4 | 2.2 | 156 |
| Binding affinity cyno TfR1 d9 (nM) | 19.51 | 15.58 | 5.01 | 16.40 | 127.50 |
| DMPK oligo conjugate binding to hTfR1 (nM) | 1.14 | N/A | N/A | 1.18 | 2.22 |
| DMPK oligo conjugate binding to cyno TfR1 (nM) | 2.26 | N/A | N/A | 1.85 | 5.12 |

. . .

| | Variant | | | | |
|---|---|---|---|---|---|
| Criteria | 3A4 (VH3-N54S/Vk4) | 3A4 (VH3/Vk4) | 5H12 (VH5-C33Y/Vk3) | 5H12 (VH5-C33D/Vk4) | 5H12 (VH4-C33Y/Vk4) |
| Binding affinity hTfR1 d0 (nM) | 1.6 | 1.5 | 6.3 | 6 | 2.8 |
| Binding affinity hTfR1 d9 (nM) | 0.65 | 0.46 | 71.90 | 92.34 | 1731.00 |
| Binding affinity cyno TfR1 d0 (nM) | 398 | 122 | 2.1 | 3.5 | 3.3 |
| Binding affinity cyno TfR1 d9 (nM) | 248.30 | 878.40 | 0.69 | 0.63 | 0.26 |
| DMPK oligo conjugate binding to hTfR1 (nM) | 2.71 | 2.837 | N/A | 110.5 | 13.9 |
| DMPK oligo conjugate binding to cyno TfR1 (nM) | 4.1 | 7.594 | N/A | 10.18 | 13.9 |

TABLE 13

Kinetic analysis of humanized anti-TfR Fabs binding to TfR1

| Humanized anti-TfR Fabs | $k_a$ (1/Ms) | $k_d$ (1/s) | $K_D$ (M) | $R_{MAX}$ | Chi$^2$ (RU$^2$) |
|---|---|---|---|---|---|
| 3A4 (VH3/Vk4) | 7.65E+10 | 1.15E+02 | 1.50E−09 | 48.0 | 0.776 |
| 3A4 (VH3-N54S/Vk4) | 4.90E+10 | 6.56E+01 | 1.34E−09 | 49.4 | 0.622 |
| 3A4 (VH3-N54T/Vk4) | 2.28E+05 | 7.05E−04 | 3.09E−09 | 61.1 | 1.650 |
| 3M12 (VH3/Vk2) | 2.64E+05 | 1.04E−04 | 3.95E−10 | 78.4 | 0.037 |
| 3M12 (VH3/Vk3) | 2.42E+05 | 8.34E−05 | 3.45E−10 | 91.1 | 0.025 |
| 3M12 (VH4/Vk2) | 2.52E+05 | 9.98E−05 | 3.96E−10 | 74.8 | 0.024 |
| 3M12 (VH4/Vk3) | 2.52E+05 | 8.61E−05 | 3.41E−10 | 82.4 | 0.030 |
| 5H12 (VH5-C33D/Vk4) | 6.78E+05 | 6.72E−04 | 9.91E−10 | 49.3 | 0.093 |
| 5H12 (VH5-C33Y/Vk3) | 1.95E+05 | 1.22E−04 | 6.27E−10 | 68.5 | 0.021 |
| 5H12 (VH5-C33Y/Vk4) | 1.86E+05 | 1.17E−04 | 6.26E−10 | 75.2 | 0.026 |

Binding of Humanized Anti-TfR1 Fabs to TfR1 (ELISA)

Figure 9A:
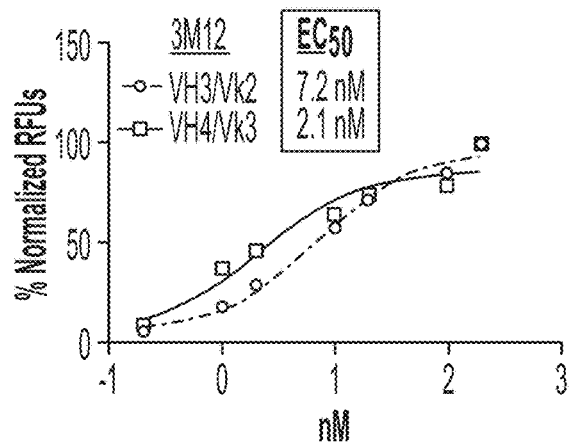
FIGS. 9A-9F show binding of humanized anti-TfR Fabs to human TfR1 (hTfR1) or cynomolgus monkey TfR1 (cTfR1), as measured by ELISA.
Figure 9B:
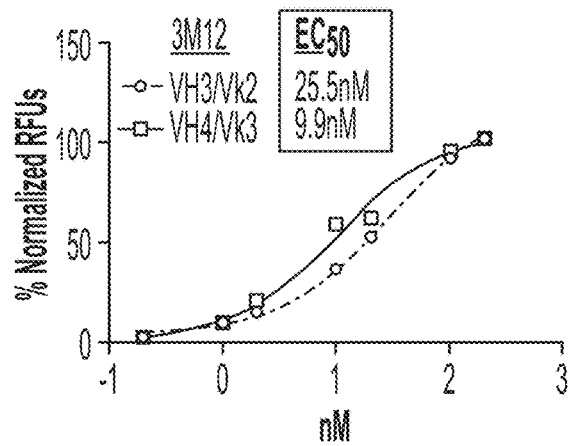
Figure 9C:
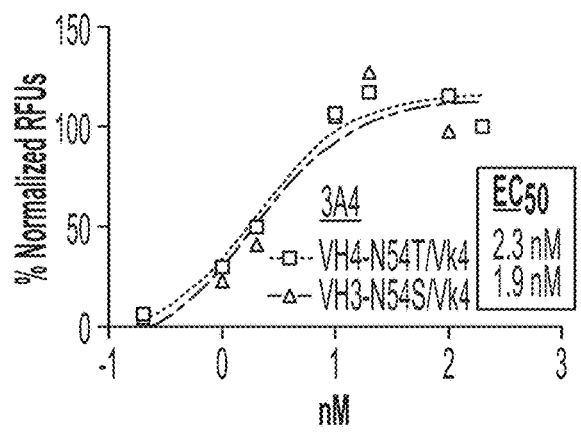
Figure 9D:
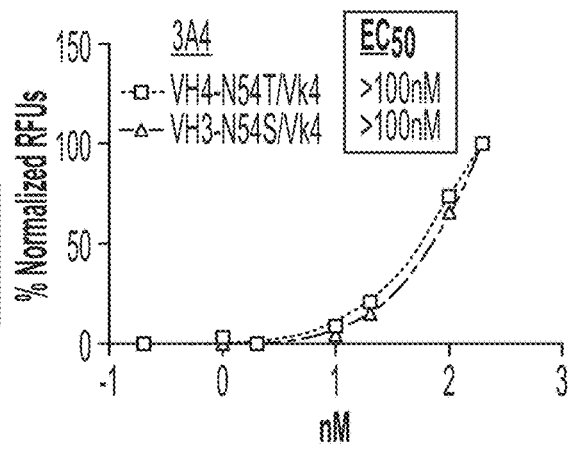
Figure 9E:
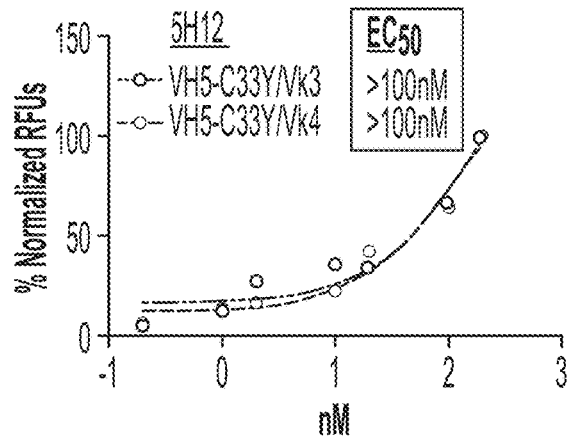
Figure 9F:
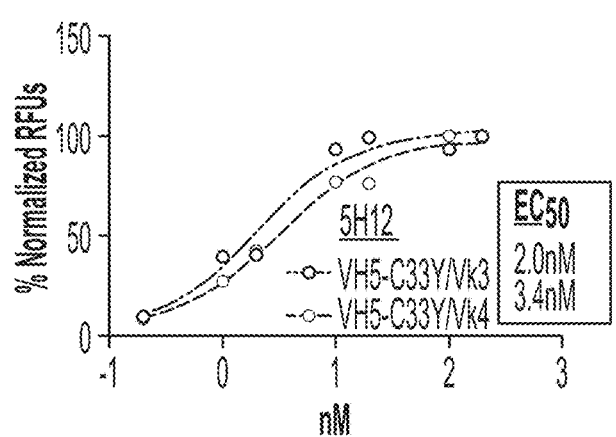

To measure binding of humanized anti-TfR antibodies to TfR1, ELISAs were conducted. High binding, black, flat bottom, 96 well plates (Corning #3925) were first coated with 100 µL/well of recombinant huTfR1 at 1 µg/mL in PBS and incubated at 4° C. overnight. Wells were emptied and residual liquid was removed. Blocking was conducted by adding 200 µL of 1% BSA (w/w) in PBS to each well. Blocking was allowed to proceed for 2 hours at room temperature on a shaker at 300 rpm. After blocking, liquid was removed and wells were washed three times with 300 µL of TBST. Anti-TfR1 antibodies were then added in 0.5% BSA/TBST in triplicate in an 8 point serial dilution (dilution range 5 µg/mL-5 ng/ml). A positive control and isotype controls were also included on the ELISA plate. The plate was incubated at room temperature on an orbital shaker for 60 minutes at 300 rpm, and the plate was washed three times with 300 µL of TBST. Anti-(H+L) IgG-A488 (1:500) (Invitrogen #A11013) was diluted in 0.5% BSA in TBST, and 100 µL was added to each well. The plate was then allowed to incubate at room temperature for 60 minutes at 300 rpm on orbital shaker. The liquid was removed and the plate was washed four times with 300 L of TBST. Absorbance was then measured at 495 nm excitation and 50 nm emission (with a 15 nm bandwidth) on a plate reader. Data was recorded and analyzed for $EC_{50}$. The data for binding to human TfR1 (hTfR1) for the humanized 3M12, 3A4 and 5H12 Fabs are shown in FIGS. 9A, 9C, and 9E, respectively. ELISA measurements were conducted using cynomolgus monkey (Macaca fascicularis) TfR1 (cTfR1) according to the same protocol described above for hTfR1, and results are shown in FIGS. 9B, 9D, and 9F.

Results of these two sets of ELISA analyses for binding of the humanized anti-TfR Fabs to hTfR1 and cTfR1 demonstrate that humanized 3M12 Fabs show consistent binding to both hTfR1 and cTfR1, and that humanized 3A4 Fabs show decreased binding to cTfR1 relative to hTfR1.

Antibody-oligonucleotide conjugates were prepared using six humanized anti-TfR Fabs, each of which were conjugated to a DMPK targeting oligonucleotide ASO300. Conjugation efficiency and down-stream purification were characterized, and various properties of the product conjugates were measured. The results demonstrate that conjugation efficiency was robust across all 10 variants tested, and that the purification process (hydrophobic interaction chromatography followed by hydroxyapatite resin chromatography) were effective. The purified conjugates showed a >97% purity as analyzed by size exclusion chromatography.

Figure 10:
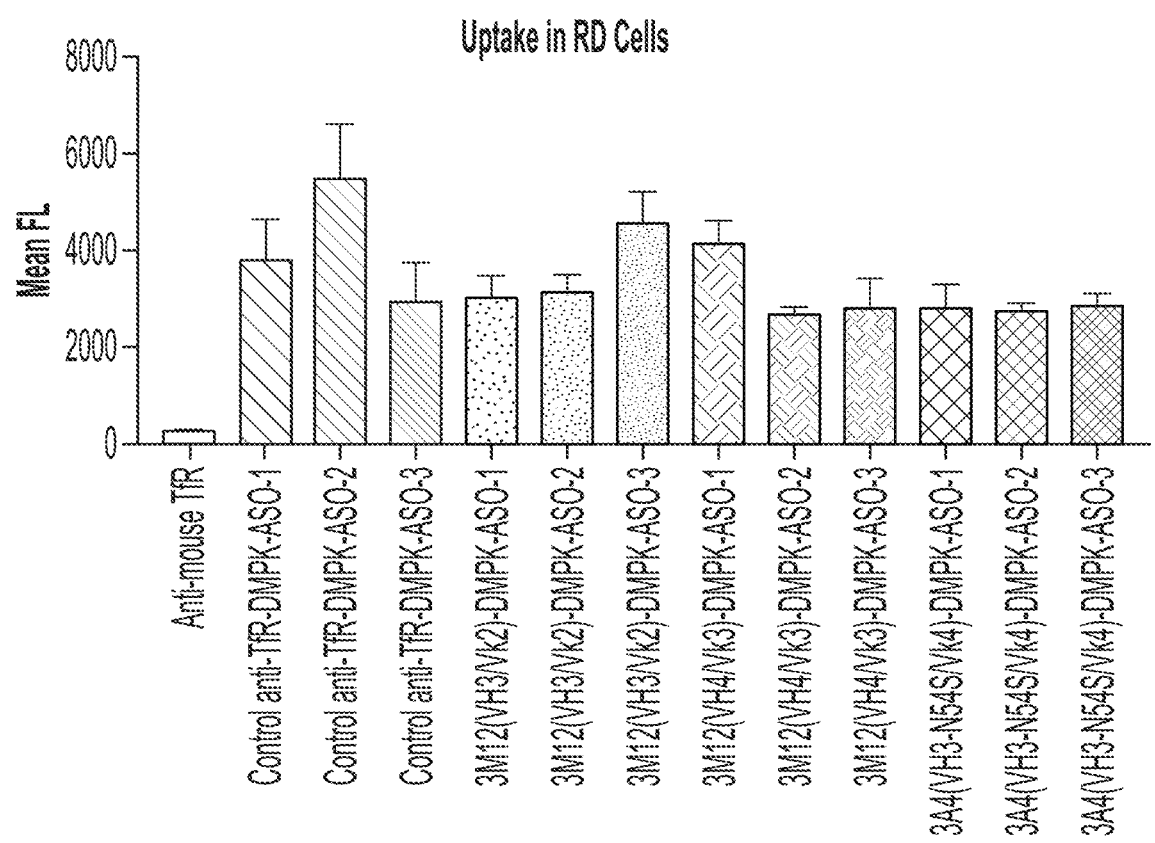
FIG. 10 shows the quantified cellular uptake of anti-TfR Fab conjugates into rhabdomyosarcoma (RD) cells. The molecular payload in the tested conjugates are DMPK-targeting oligonucleotides and the uptake of the conjugates were facilitated by indicated anti-TfR Fabs. Conjugates having a negative control Fab (anti-mouse TfR) or a positive control Fab (anti-human TfR1) are also included this assay. Cells were incubated with indicated conjugate at a concentration of 100 nM for 4 hours. Cellular uptake was measured by mean Cypher5e fluorescence.

Several humanized Fabs were tested in cellular uptake experiments to evaluate TfR1-mediated internalization. To measure such cellular uptake mediated by antibodies, humanized anti-TfR Fab conjugates were labeled with Cypher5c, a pH-sensitive dye. Rhabdomyosarcoma (RD) cells were treated for 4 hours with 100 nM of the conjugates, trypsinized, washed twice, and analyzed by flow cytometry. Mean Cypher5e fluorescence (representing uptake) was calculated using Attune N×T software. As shown in FIG. 10, the humanized anti-TfR Fabs show similar or greater endosomal uptake compared to a positive control anti-TfR1 Fab. Similar internalization efficiencies were observed for different oligonucleotide payloads. An anti-mouse TfR antibody was used as the negative control. Cold (non-internalizing) conditions abrogated the fluorescence signal of the positive control antibody-conjugate (data not shown), indicating that the positive signal in the positive control and humanized anti-TfR Fab-conjugates is due to internalization of the Fab-conjugates. Similarly, an oligonucleotide that induces DMD exon skipping can also be conjugated the humanized anti-TfR Fabs for cellular uptake by muscle cells.

Figure 11A:
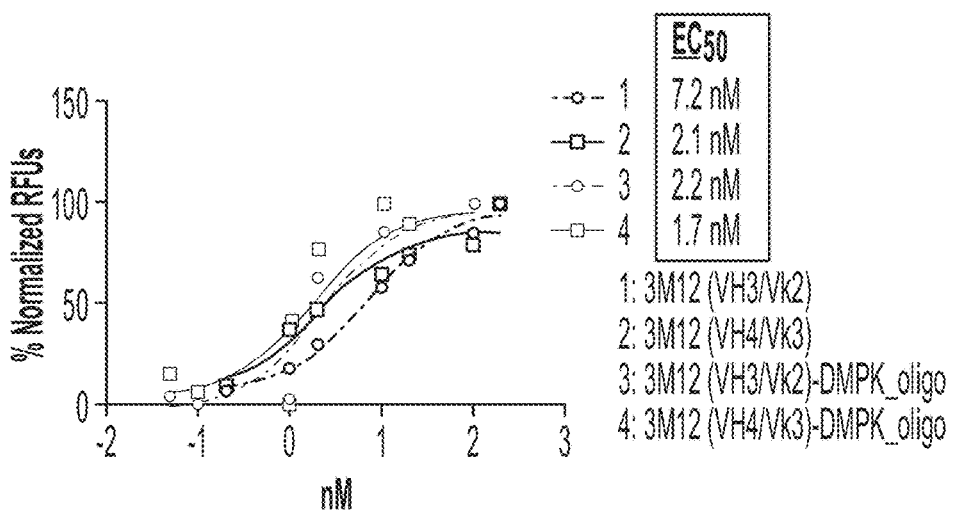
FIGS. 11A-11F show binding of oligonucleotide-conjugated or unconjugated humanized anti-TfR Fabs to human TfR1 (hTfR1) and cynomolgus monkey TfR1 (cTfR1), as measured by ELISA.
Figure 11B:
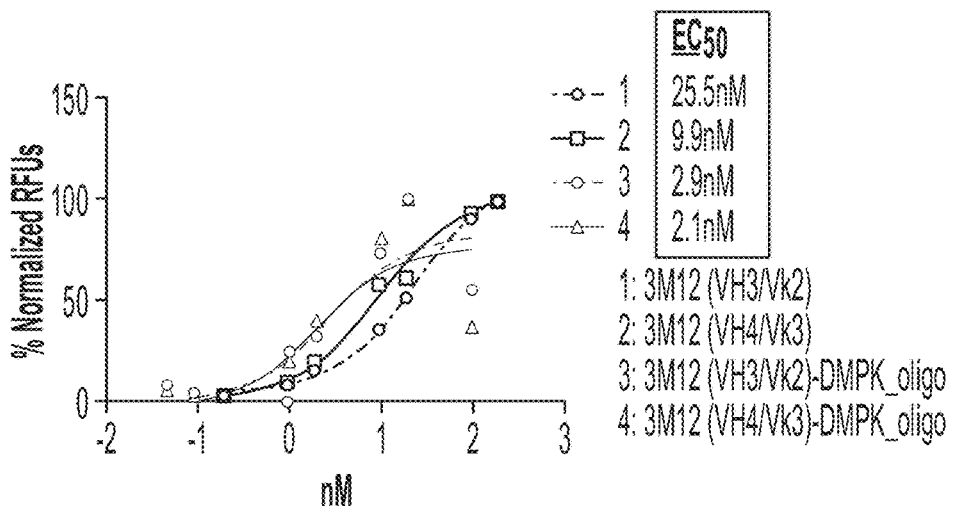
Figure 11C:
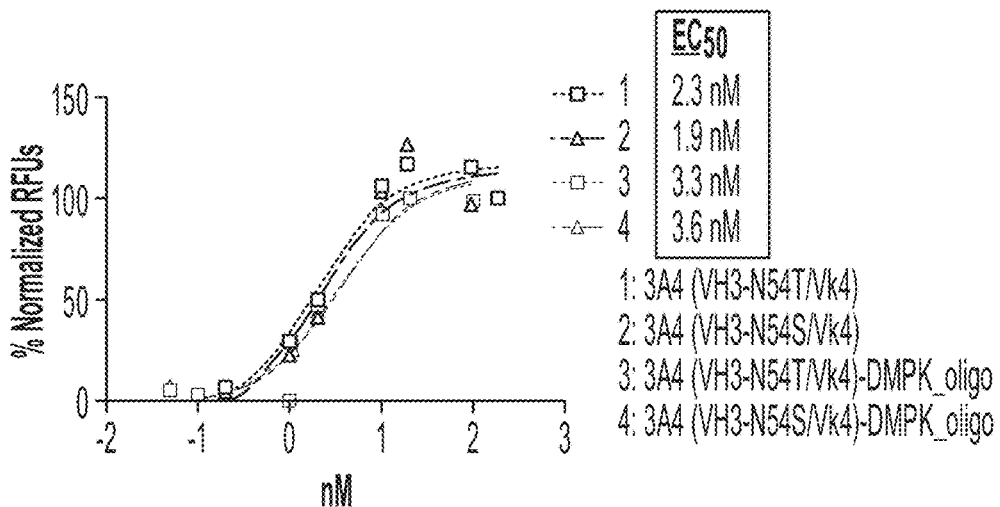
Figure 11D:
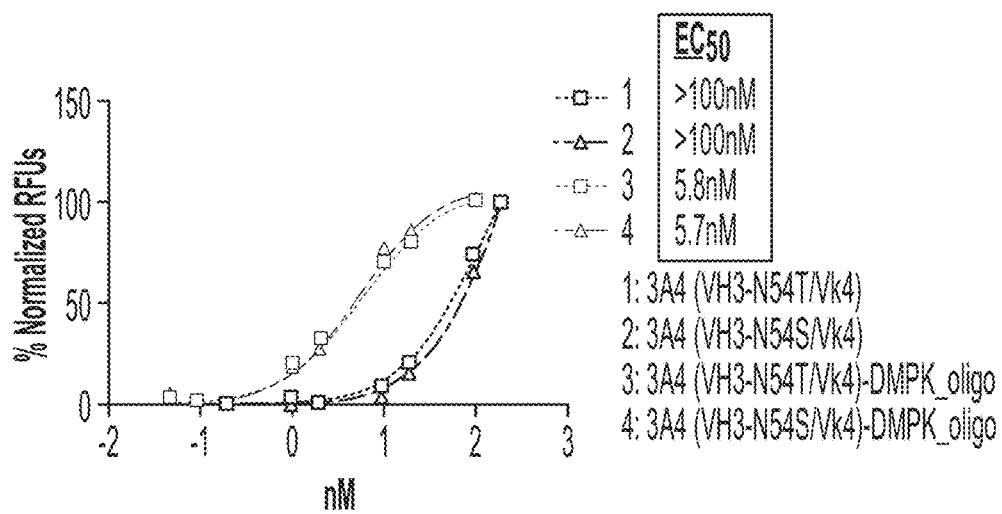
Figure 11E:
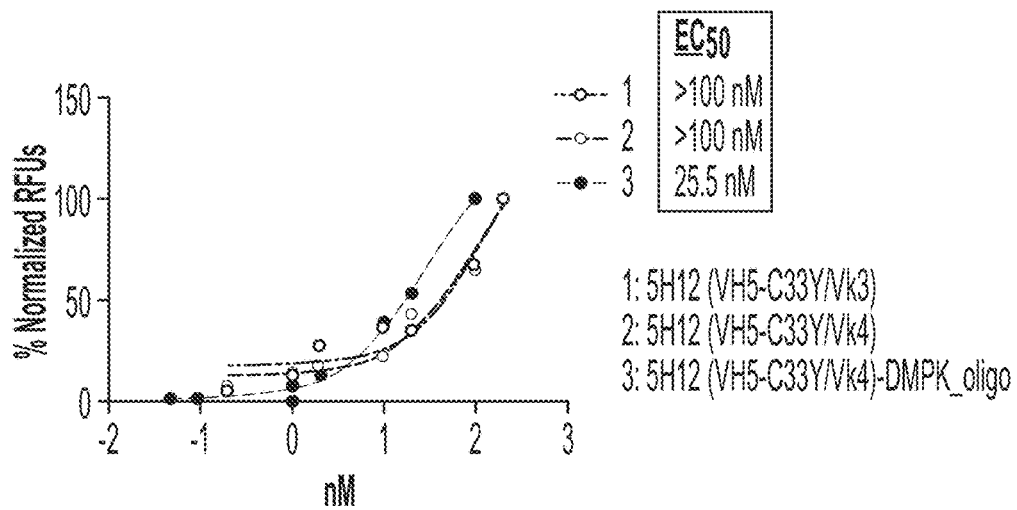
Figure 11F:
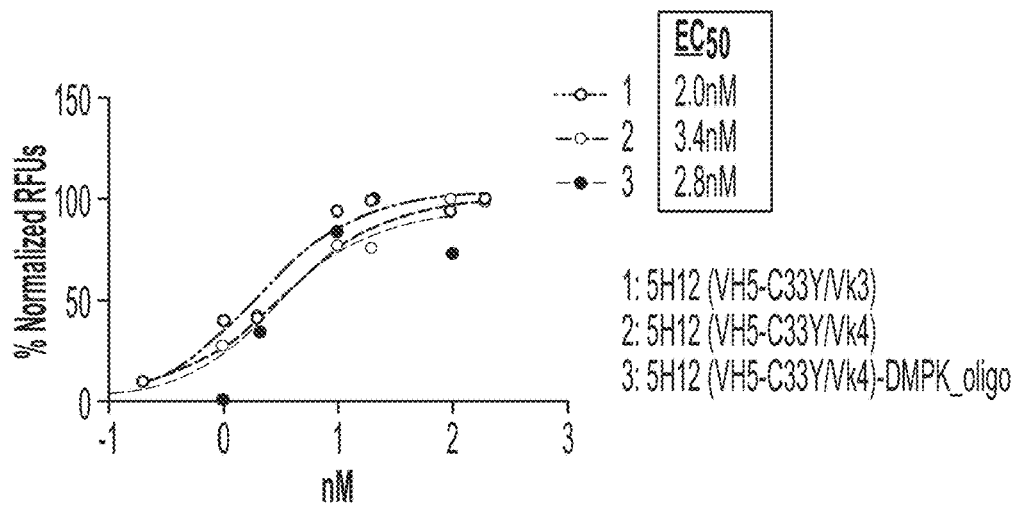

Conjugates of six humanized anti-TfR Fabs of were also tested for binding to hTfR1 and cTfR1 by ELISA, and compared to the unconjugated forms of the humanized Fabs. Results demonstrate that humanized 3M12 and 5H12 Fabs maintain similar levels of hTfR1 and cTfR1 binding after conjugation relative to their unconjugated forms (3M12, FIGS. 11A and 11B; 5H12, FIGS. 11E and 11F). Interestingly, 3A4 clones show improved binding to cTfR1 after conjugation relative to their unconjugated forms (FIGS. 11C and 11D).

As used in this Example, the term 'unconjugated' indicates that the antibody was not conjugated to an oligonucleotide.

Example 10. Knockdown of DMPK mRNA Level Facilitated by Antibody-Oligonucleotide Conjugates In Vitro Conjugates containing humanized anti-TfR Fabs 3M12 (VH3/Vk2), 3M-12 (VH4/Vk3), and 3A4 (VH3-N54S/Vk4) were conjugated to a DMPK-targeting oligonucleotide ASO300 and were tested in rhabdomyosarcoma (RD) cells for knockdown of DMPK transcript expression. Antibodies were conjugated to ASO300 via the linker shown in Formula (C).

RD cells were cultured in a growth medium of DMEM with glutamine, supplemented with 10% FBS and penicillin/streptomycin until nearly confluent. Cells were then seeded into a 96 well plate at 20K cells per well and were allowed to recover for 24 hours. Cells were then treated with the conjugates for 3 days. Total RNA was collected from cells, cDNA was synthesized and DMPK expression was measured by qPCR.

Figure 12:
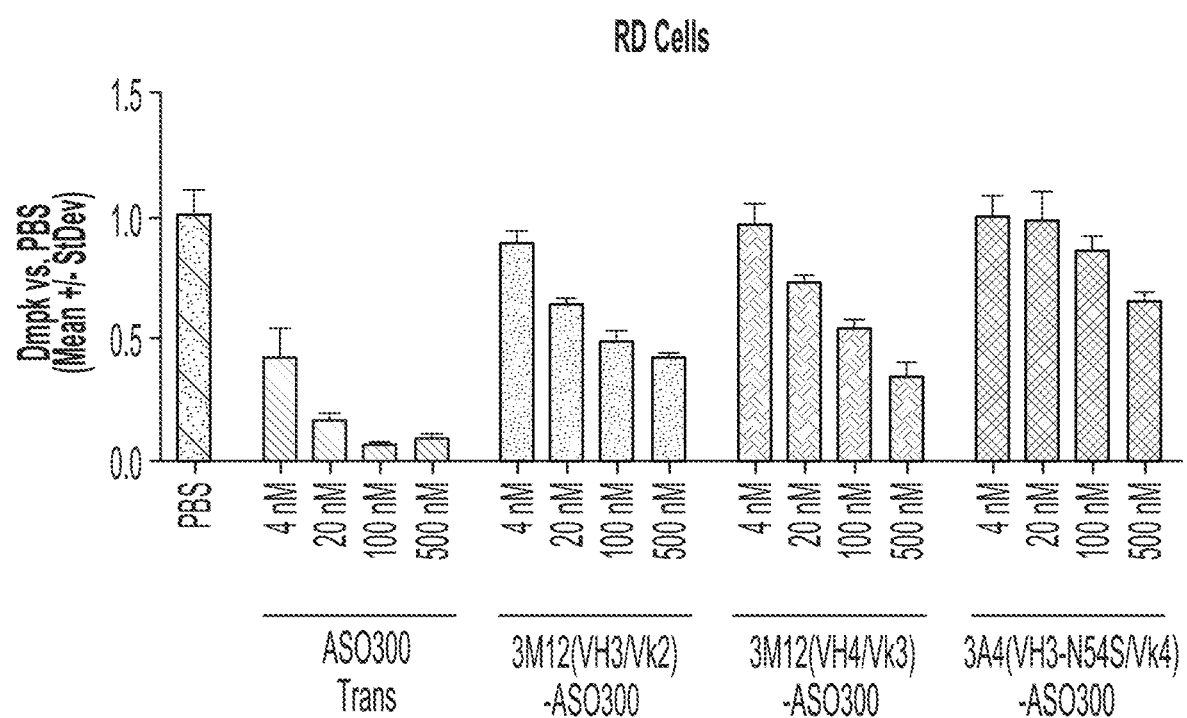
FIG. 12 shows DMPK expression in RD cells treated with various concentrations of conjugates containing the indicated humanized anti-TfR antibodies conjugated to a DMPK-targeting oligonucleotide ASO300. The duration of treatment was 3 days. ASO300 delivered using transfection agents were used as control.

Results in FIG. 12 show that DMPK expression level was reduced in cells treated with each indicated conjugate, relative to expression in PBS-treated cells, indicating that the humanized anti-TfR Fabs are able to mediate the uptake of the DMPK-targeting oligonucleotide by the RD cells and that the internalized DMPK-targeting oligonucleotide are effective in knocking down DMPK mRNA level.

Similarly, an oligonucleotide that induces DMD exon skipping can also be conjugated the humanized anti-TfR Fabs for delivery to muscle cells and inducing DMD exon skipping in muscle cells.

Figure 14:
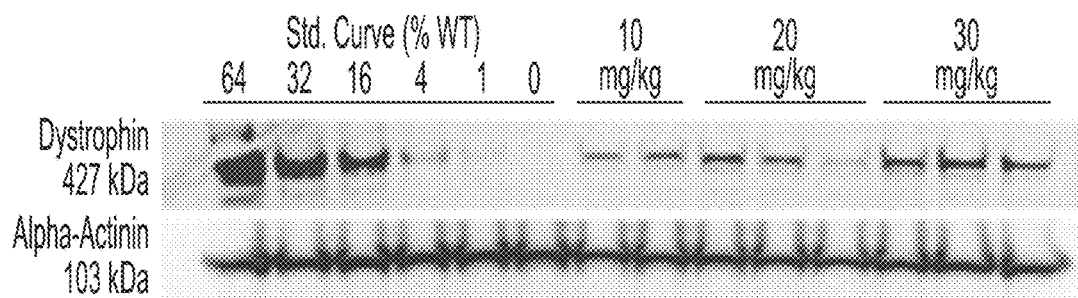
FIG. 14 shows dose-dependent increase of dystrophin expression in quadriceps muscles of mdx mice after treatment with anti-mouse TfR1 (RI7 217) conjugated to an oligonucleotide (a PMO) targeted to exon 23, as measured by western blotting for dystrophin, with alpha-actin as a loading control. The standards were generated using pooled wild-type protein and pooled mdx protein. The percent indicates the amount of WT protein spiked into the sample.
Figure 15:
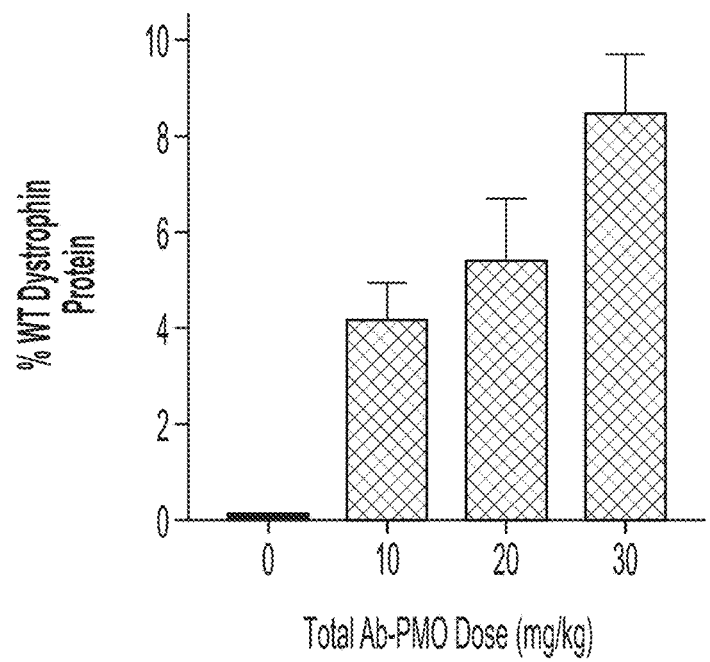
FIG. 15 shows quantification of dystrophin protein levels within quadriceps muscles of mdx mice after treatment with various doses of anti-mouse TfR (RI7 217) conjugated to an oligonucleotide (a PMO) targeting exon 23.

Example 11. Anti-TfR-Oligonucleotide Conjugate Treatment Increased Dystrophin Expression in Mdx Mouse Model of DMD To test the effects of another oligonucleotide that induces DMD exon skipping in vivo, an oligonucleotide (PMO) that induces exon 23 skipping was administered as naked oligonucleotide or in conjugate with an anti-mouse TfR antibody to the mdx mouse model of DMD. Dystrophin expression was measured. The exon skipping promoted by the conjugate resulted in dose-dependent production of dystrophin protein as illustrated by western blot (FIG. 14) and quantified in FIG. 15. Alpha-actin was used as a loading control.

Figure 16:
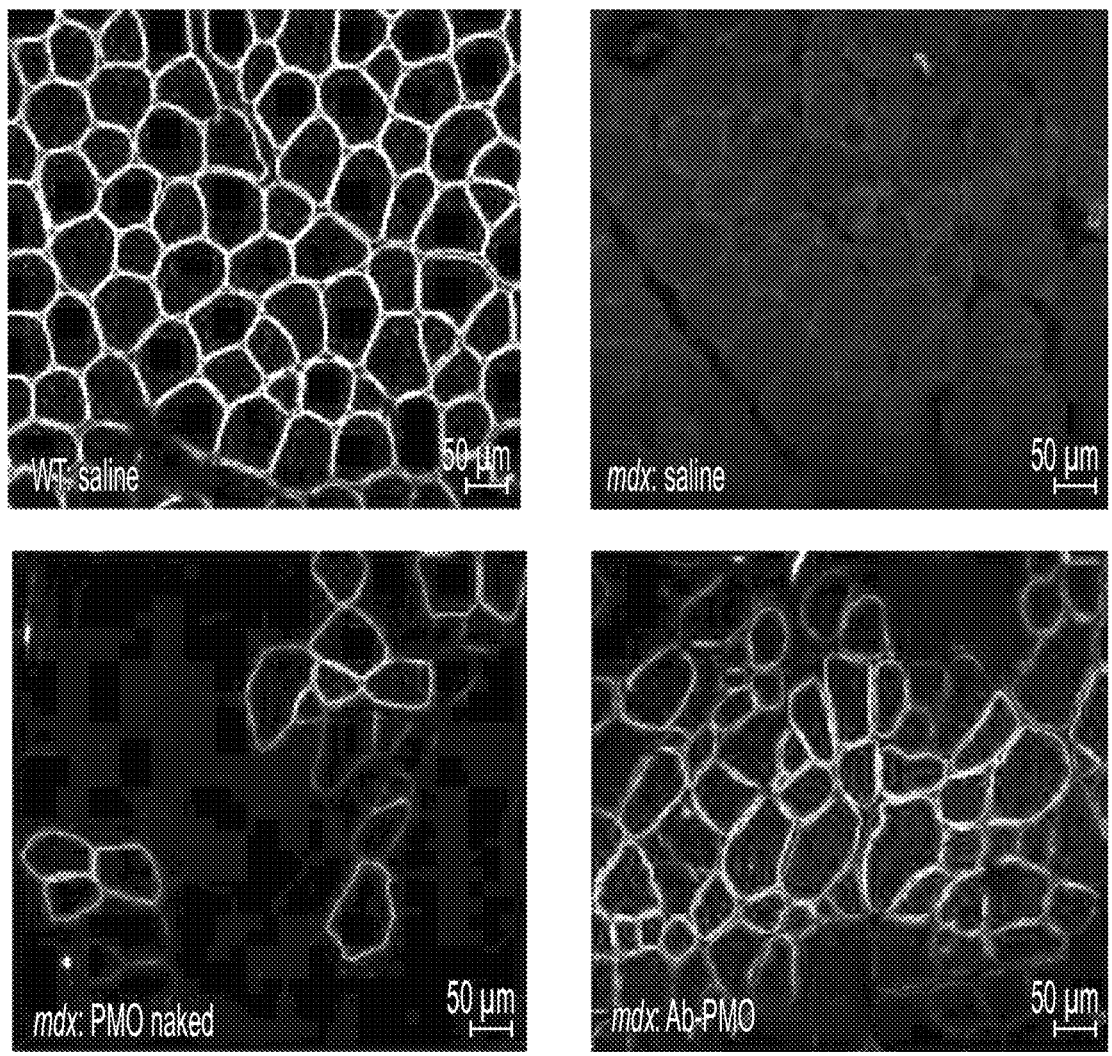
FIG. 16 shows immunofluorescent staining images of quadriceps muscles from wild-type (WT) mice treated with saline, or mdx mice treated with saline, naked oligonucleotide or oligonucleotide conjugated to anti-mouse TfR1 (RI7 217).

A single dose of the exon 23-conjugate administered in the mdx mouse also restored dystrophin expression to the muscle cell membrane in addition to increasing overall dystrophin levels, as shown in FIG. 16. Immunofluorescence staining of dystrophin in quadricep muscles demonstrated that mdx mice treated with the conjugated had higher levels of dystrophin in their quadriceps than mice treated with naked oligonucleotide or saline.

Example 12. Oligonucleotide-Mediated Exon Skipping in DMD Myotubes

Figure 13:
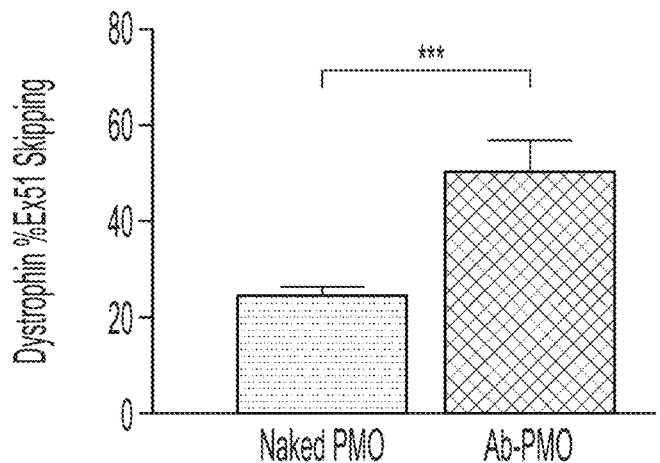
FIG. 13 shows skipping of exon 51 in human DMD myotubes, facilitated by a DMD exon 51 skipping oligonucleotide (a PMO). Cells were treated with the naked PMO or with PMO conjugated to an anti-TfR1 Fab (Ab-PMO).

Promoting the skipping of specific DMD exons in the nucleus could allow muscle cells to create more complete, functional dystrophin protein. An oligonucleotide (PMO) that induces skipping of DMD exon 51 was conjugated to an anti-TfR1 Fab and the conjugated was tested in human DMD myotubes with a mutation amenable to Exon 51 skipping. Treatment with the conjugate resulted in a 50% increase in exon skipping as compared to a 25% increase in exon skipping following treatment with an equimolar dose of the naked oligonucleotide (p-value=0.001), as shown in FIG. 13. Similar results were observed in the mdx mouse model of DMD, such as those shown in FIG. 5.

Example 13. Serum Stability of the Linker Linking the Anti-TfR Antibody and the Molecular Payload Oligonucleotides which were linked to antibodies in examples were conjugated via a cleavable linker shown in Formula (C). It is important that the linker maintain stability in serum and provide release kinetics that favor sufficient payload accumulation in the targeted muscle cell. This serum stability is important for systemic intravenous administration, stability of the conjugated oligonucleotide in the bloodstream, delivery to muscle tissue and internalization of the therapeutic payload in the muscle cells. The linker has been confirmed to facilitate precise conjugation of multiple types of payloads (including ASOs, siRNAs and PMOs) to Fabs. This flexibility enabled rational selection of the appropriate type of payload to address the genetic basis of each muscle disease. Additionally, the linker and conjugation chemistry allowed the optimization of the ratio of payload molecules attached to each Fab for each type of payload, and enabled rapid design, production and screening of molecules to enable use in various muscle disease applications.

Figure 8:
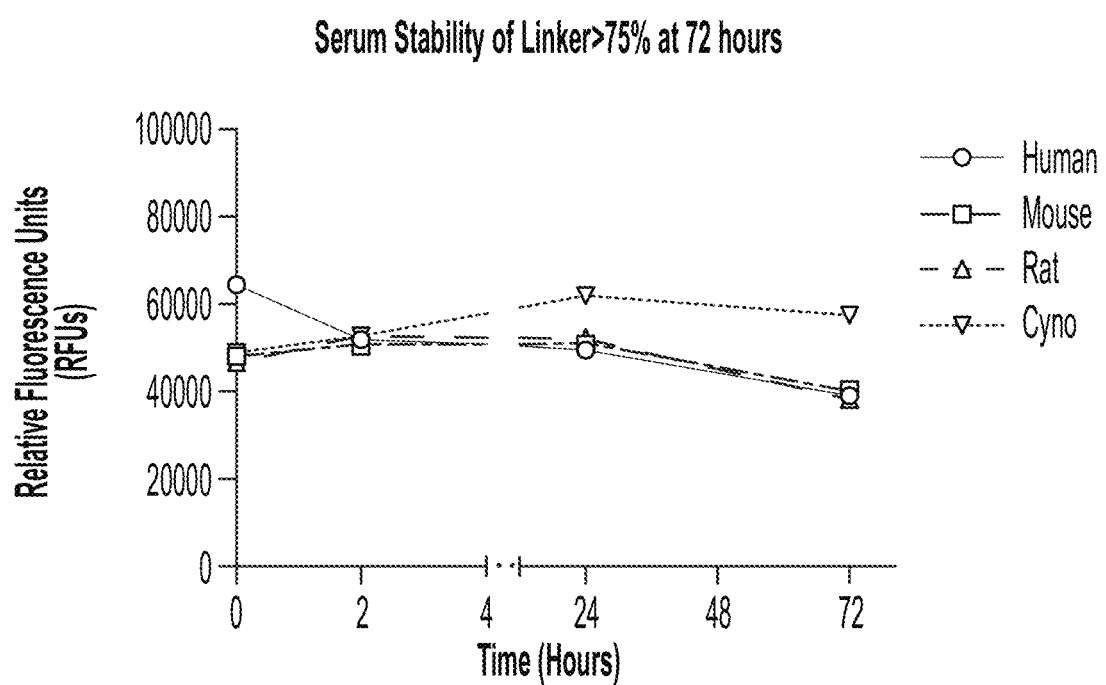
FIG. 8 shows the serum stability of the linker used for linking an anti-TfR antibody and a molecular payload (e.g., an oligonucleotide) in various species over time after intravenous administration.

FIG. 8 shows serum stability of the linker in vivo, which was comparable across multiple species over the course of 72 hours after intravenous dosing. At least 75% stability was measured in each case at 72 hours after dosing.

Example 14. Exon-Skipping Activity of Anti-TfR Conjugates in DMD Patient Myotubes In this study, the exon-skipping activities of anti-TfR conjugates containing an anti-TfR Fab (3M12 VH3/Vκ2, 3M12 VH4/Vκ3, and 3A4 VH3 N54S/Vκ4) conjugated to a DMD exon 51-skipping oligonucleotide were evaluated. Immortalized human myoblasts bearing an exon 52 deletion were thawed and seeded at a density of 1e6 cell/flask in Promocell Skeletal Cell Growth Media (with 5% FBS and 1×Pen-Strep) and allowed to grow to confluency. Once confluent, cells were trypsinized and pelleted via centrifugation and resuspended in fresh Promocell Skeletal Cell Growth Media. The cell number was counted and cells were seeded into Matrigel-coated 96-well plates at a density of 50 k cells/well. Cells were allowed to recover for 24 hours. Cells were induced to differentiate by aspirating the growth media and replacing with differentiation media with no serum. Cells were then treated with conjugated or unconjugated DMD exon skipping oligonucleotide at 10 µM. Cells were incubated with test articles for ten days then total RNA was harvested from the 96 well plates. cDNA synthesis was performed on 75 ng of total RNA, and mutation specific PCRs were performed to evaluate the degree of exon 51 skipping in each cell type. Mutation-specific PCR products were run on a 4% agarose gel and visualized using SYBR gold. Densitometry was used to calculate the relative amounts of the skipped and unskipped amplicon and exon skipping was determined as a ratio of the Exon 51 skipped amplicon divided by the total amount of amplicon present:

$$\% \text{ Exon Skipping} = \frac{\text{Skipped Amplicon}}{(\text{Skipped Amplicon} + \text{Unskipped Amplicon})} * 100$$

Figure 17:
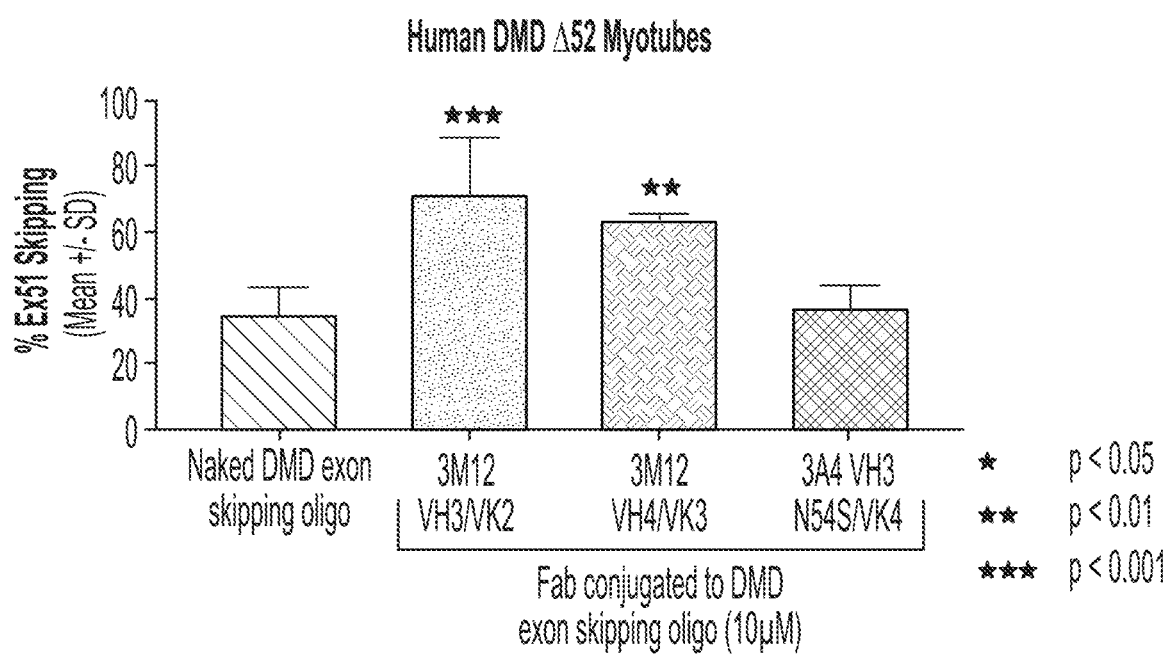
FIG. 17 shows data illustrating that conjugates containing designated anti-TfR Fabs (3M12 VH3/VK2, 3M12 VH4/VK3, and 3A4 VH3 N54S/VK4) conjugated to a DMD exon-skipping oligonucleotide resulted in enhanced exon skipping compared to the naked DMD exon skipping oligo in DMD patient myotubes.

The results demonstrate that the conjugates with either 3M12 VH3/Vκ2 or 3M12 VH4/Vκ3 Fab covalently linked to the DMD exon 51-skipping oligonucleotide resulted in enhanced exon skipping compared to the unconjugated DMD exon skipping oligonucleotide in patient myotubes (FIG. 17).

As used in this Example, the term 'unconjugated' indicates that the oligonucleotide was not conjugated to an antibody.

Example 15. Characterization of Binding Activities of Anti-TfR Fab 3M12 VH4/Vk3

Figure 18:
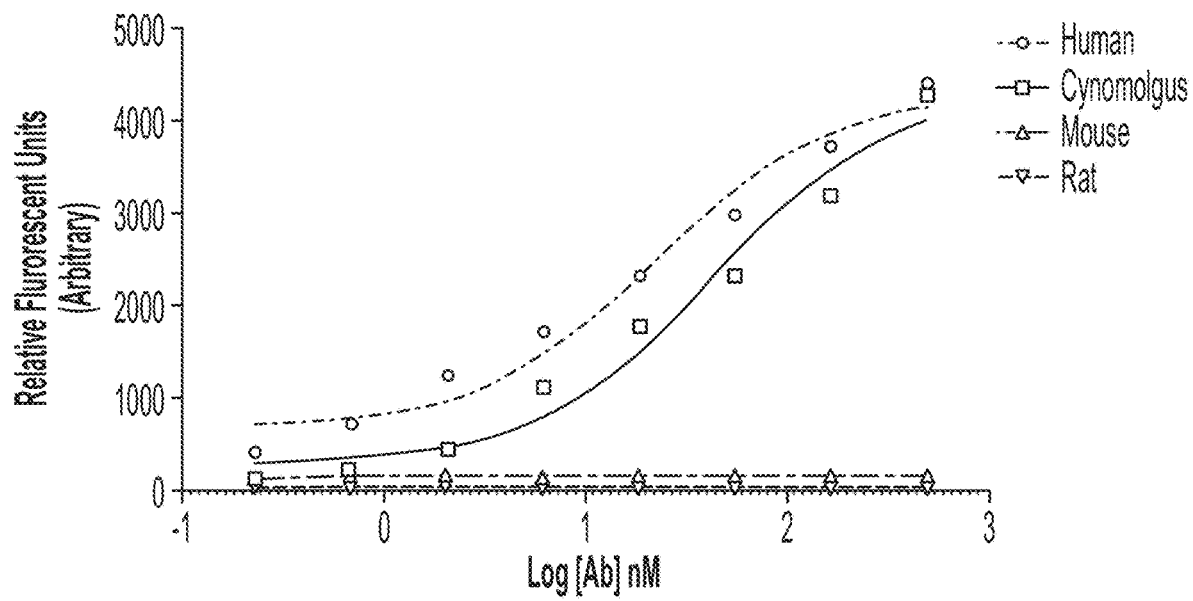
FIG. 18 shows ELISA measurements of binding of anti-TfR Fab 3M12 VH4/Vk3 to recombinant human (circles), cynomolgus monkey (squares), mouse (upward triangles), or rat (downward triangles) TfR1 protein, at a range of concentrations from 230 pM to 500 nM of the Fab. Measurement results show that the anti-TfR Fab is reactive with human and cynomolgus monkey TfR1. Binding was not observed to mouse or rat recombinant TfR1. Data is shown as relative fluorescent units normalized to baseline.

In vitro studies were performed to test the specificity of anti-TR Fab 3M12 VH4/Vκ3 for human and cynomolgus monkey TfR1 binding and to confirm its selectivity for human TfR1 vs TfR2. The binding affinity of anti-TfR Fab 3M12 VH4/Vκ3 to TfR1 from various species was determined using an enzyme-linked immunosorbent assay (ELISA). Serial dilutions of the Fab were added to plates precoated with recombinant human, cynomolgus monkey, mouse, or rat TfR1. After a short incubation, binding of the Fab was quantified by addition of a fluorescently tagged anti-(H+L) IgG secondary antibody and measurement of fluorescence intensity at 495 nm excitation and 520 nm emission. The Fab showed strong binding affinity to human and cynomolgus monkey TfR1, and no detectable binding of mouse or rat TfR1 was observed (FIG. 18). Surface plasmon resonance (SPR) measurements were also conducted, and results are shown in Table 18. The $K_d$ of the Fab against the human TfR1 receptor was calculated to be $7.68 \times 10^{-10}$ M and against the cynomolgus monkey TfR1 receptor was calculated to be $5.18 \times 10^{-9}$ M.

TABLE 18

Kinetic analysis of anti-TfR Fab 3M12 VH4/Vk3 binding to human and cynomolgus monkey TfR1 or human TfR2, measured using surface plasmon resonance

| Target | Anti-TfR Fab 3M12 VH4/Vk3 | | | | |
|---|---|---|---|---|---|
| | $K_d$ (M) | $k_a$ (M$^{-1}$ s$^{-1}$) | $k_d$ (s$^{-1}$) | $R_{max}$ | $R_{es}$ SD |
| Human TfR1 | 7.68E−10 | 1.66E+05 | 1.27E−04 | 1.11E+02 | 3.45E+00 |
| Cyno TfR1 | 5.18E−09 | 9.19E+04 | 4.76E−04 | 1.87E+02 | 6.24E+00 |
| Human TfR2 | ND | ND | ND | ND | ND |

ND = No detectable binding by SPR (10 pM-100 uM)

Figure 19:
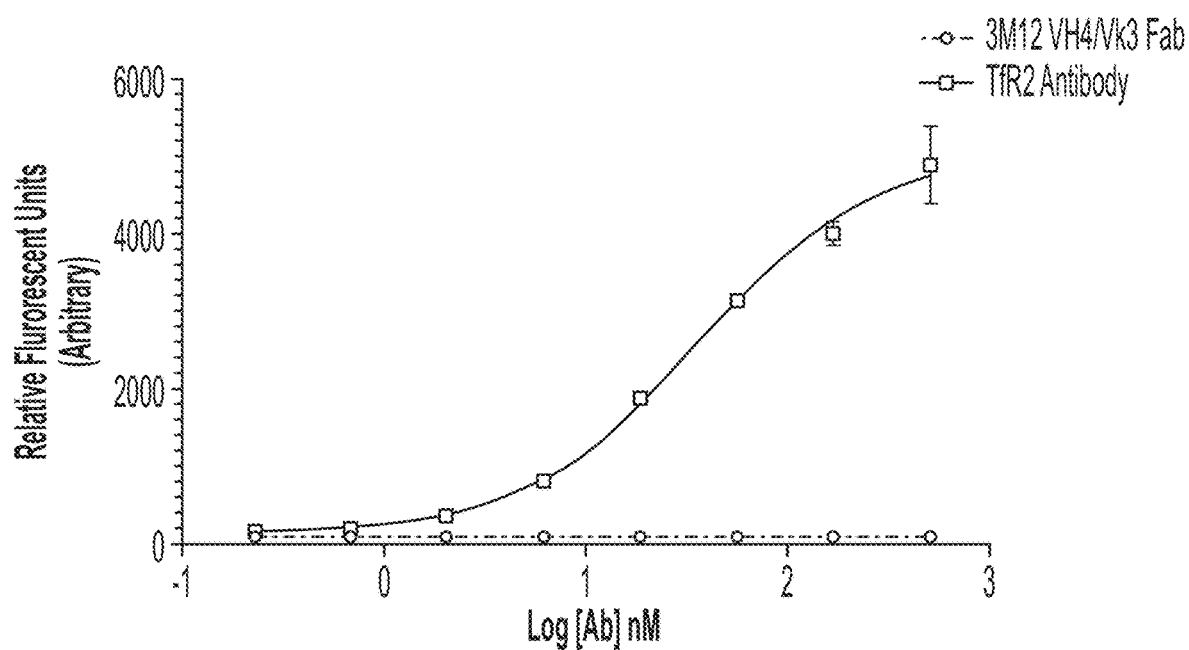
FIG. 19 shows results of an ELISA testing the affinity of anti-TfR Fab 3M12 VH4/Vk3 to recombinant human TfR1 or TfR2 over a range of concentrations from 230 pM to 500 nM of Fab. The data are presented as relative fluorescence units normalized to baseline. The results demonstrate that the Fab does not bind recombinant human TfR2.

To test for cross-reactivity of anti-TfR Fab 3M12 VH4/Vk3 to human TfR2, an ELISA was performed. Recombinant human TfR2 protein was plated overnight at 2 µg/mL and was blocked for 1 hour with 1% bovine serum albumin (BSA) in PBS. Serial dilutions of the Fab or a positive control anti-TfR2 antibody were added in 0.5% BSA/TBST for 1 hour. After washing, anti-(H+L) IgG-A488 (Invitrogen #MA5-25932) fluorescent secondary antibody was added at a 1:500 dilution in 0.5% BSA/TBST and the plate was incubated for 1 hour. Relative fluorescence was measured using a Biotek Synergy plate reader at 495 nm excitation and 520 nm emission. No binding of anti-TfR Fab 3M12 VH4/Vk3 to hTfR2 was observed (FIG. 19).

Example 16. Serum Stability of Anti-TfR Fab-ASO Conjugate

Figure 20:
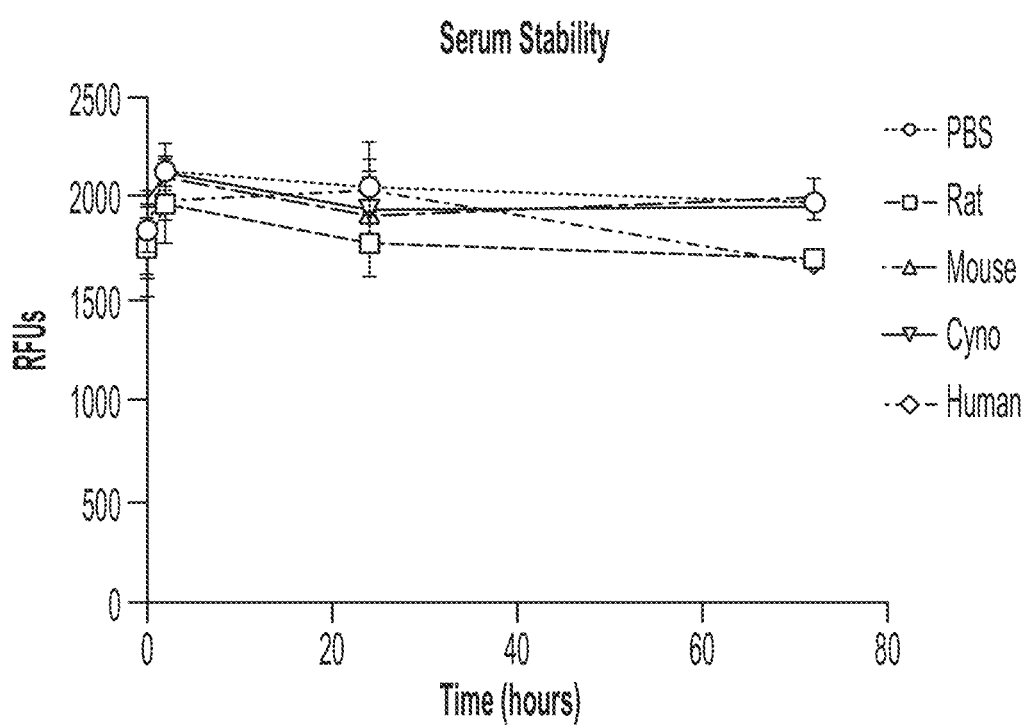
FIG. 20 shows the serum stability of the linker used for linking anti-TfR Fab 3M12 VH4/Vk3 to a control antisense oligonucleotide over 72 hours incubation in PBS or in rat, mouse, cynomolgus monkey or human serum.

Anti-TfR Fab VH4/Vk3 was conjugated to a control antisense oligonucleotide (ASO) via a linker as shown in Formula (C) and the resulting conjugate was tested for stability of the linker conjugating the Fab to the ASO. Serum stability was measured by incubating fluorescently labeled conjugate in PBS or in rat, mouse, cynomolgus monkey, or human serum and measuring relative fluorescence intensity over time, with higher fluorescence indicating more conjugate remaining intact. FIG. 20 shows serum stability was similar across multiple species and remained high after 72 hours.

Example 17. Exon Skipping Activity of Anti-TfR Fab-ASO Conjugate In Vivo in Cynomolgus Monkeys Anti-TfR Fab 3M12 VH4/Vk3 was conjugated to a dystrophin (DMD) exon 51-skipping antisense oligonucleotide (ASO) targeting an ESE as set forth in SEQ ID NO: 419. The exon 51 skipping oligonucleotide is a phosphorodiamidate morpholino oligomer (PMO) of 30 nucleotides in length. The exon skipping activity of the conjugate was tested in vivo in healthy non-human primates. Naïve male cynomolgus monkeys (n=4-5 per group) were administered two doses of vehicle, 30 mg/kg ASO alone, or 122 mg/kg conjugate (30 mg/kg ASO equivalent) via intravenous infusion on days 1 and 8. Animals were sacrificed and tissues harvested either 2 weeks or 4 weeks after the first dose was administered. Total RNA was collected from tissue samples using a Promega Maxwell® RSC instrument and cDNA synthesis was performed using qScript cDNA SuperMix. Assessment of exon 51 skipping was performed using end-point PCR.

Capillary electrophoresis of the PCR products was used to assess exon skipping, and % exon 51 skipping was calculated using the following formula:

$$\% \text{ Exon Skipping} = \frac{\text{Molarity of Skipped Band}}{\text{Molarity of Skipped Band} + \text{Molarity of Unskipped Band}} * 100.$$

Calculated exon 51 skipping results are shown in Table 19.

TABLE 19

Exon 51 skipping of dystrophin in cynomolgus monkey dystrophin

| Time Group | Vehicle | 2 weeks | | 4 weeks | |
|---|---|---|---|---|---|
| | | ASO alone[a] | Conjugate | ASO alone[a] | Conjugate |
| Conjugate dose[b] | 0 | n/a | 122 | n/a | 122 |
| ASO alone Dose[c] | 0 | 30 | 30 | 30 | 30 |
| Quadriceps [d] | 0.00 | 1.216 | 4.906 | 0.840 | 1.708 |
| | (0.00) | (1.083) | (3.131) | (1.169) | (1.395) |
| Diaphragm [d] | 0.00 | 1.891 | 7.315 | 0.717 | 9.225 |
| | (0.00) | (2.911) | (1.532) | (1.315) | (4.696) |
| Heart [d] | 0.00 | 0.043 | 3.42 | 0.00 | 4.525 |
| | (0.00) | (0.096) | (1.192) | (0.00) | (1.400) |
| Biceps [d] | 0.00 | 0.607 | 3.129 | 1.214 | 4.863 |
| | (0.00) | (0.615) | (0.912) | (1.441) | (3.881) |
| Tibialis anterior [d] | 0.00 | 0.699 | 1.042 | 0.384 | 0.816 |
| | (0.00) | (0.997) | (0.685) | (0.615) | (0.915) |
| Gastrocnemius [d] | 0.00 | 0.388 | 2.424 | 0.00 | 5.393 |
| | (0.00) | (0.573) | (2.329) | (0.00) | (2.695) |

[a]ASO = antisense oligonucleotide.
[b]Conjugate doses are listed as mg/kg of anti-TfR Fab 3M12 VH4/Vk3-ASO conjugate.
[c]ASO doses are listed as mg/kg ASO equivalent of the anti-TfR Fab 3M12 VH4/Vk3-ASO dose.
[d] Exon skipping values are mean % exon 51 skipping with standard deviations (n = 5) in parentheses.

Tissue ASO accumulation was also quantified using a hybridization ELISA with a probe complementary to the ASO sequence. A standard curve was generated and ASO levels (in ng/g) were derived from a linear regression of the standard curve. The ASO was distributed to all tissues evaluated at a higher level following the administration of the anti-TfR Fab VH4/Vk3-ASO conjugate as compared to the administration of unconjugated ASO. Intravenous administration of unconjugated ASO resulted in levels of ASO that were close to background levels in all tissues evaluated at 2 and 4 weeks after the first does was administered. Administration of anti-TfR Fab VH4/Vk3-ASO conjugate resulted in distribution of ASO through the tissues evaluated with a rank order of heart>diaphragm>bicep>quadriceps>gastrocnemious>tibialis anterior 2 weeks after first dosing. The duration of tissue concentration was also assessed. Concentrations of the ASO in quadriceps, bicep and diaphragm decreased by less than 50% over the time period evaluated (2 to 4 weeks), while levels of ASO in the heart, tibialis anterior, and gastrocnemius remained virtually unchanged (Table 20).

As used in this Example, the term 'unconjugated' indicates that the oligonucleotide was not conjugated to an antibody.

TABLE 20

Tissue distribution of DMD exon 51 skipping ASO in cynomolgus monkeys

| Time Group | Vehicle | 2 weeks ASO alone[a] | 2 weeks Conjugate | 4 weeks ASO alone[a] | 4 weeks Conjugate |
|---|---|---|---|---|---|
| Conjugate Dose[b] | 0 | n/a | 122 | n/a | 122 |
| ASO alone Dose[c] | 0 | 30 | 30 | 30 | 30 |
| Quadriceps[d] | 0 (59.05) | 696.8 (868.15) | 2436 (954.0) | 197 (134) | 682 (281) |
| Diaphragm[d] | 0± (144.3) | 580.02 (360.11) | 6750 (2256) | 60 (120) | 3131 (1618) |
| Heart[d] | 0 (396.03) | 1449 (1337) | 27138 (6315) | 943 (1803) | 30410 (9247) |
| Biceps[d] | 0 (69.58) | 615.63 (335.17) | 2840 (980.31) | 130 (80) | 1326 (623) |
| Tibialis anterior[d] | 0 (76.31) | 564.71 (327.88) | 1591 (253.50) | 169 (110) | 1087 (514) |
| Gastrocnemius[d] | 0 (41.15) | 705.47 (863.75) | 2096 (474.04) | 170 (69) | 1265 (272) |

[a] ASO = Antisense oligonucleotide.
[b] Conjugate doses are listed as mg/kg of anti-TfR Fab 3M12 VH4/Vk3-ASO conjugate.
[c] ASO doses are listed as mg/kg ASO or ASO equivalent of the anti-TfR Fab 3M12 VH4/Vk3-ASO conjugate dose.
[d] ASO values are mean concentrations of ASO in tissue as ng/g with standard deviations (n = 5) in parentheses.

Example 18. Effect of Conjugates Containing an Anti-TfR1 Fab Conjugated to an Oligonucleotide that Induces DMD Exon 23 Skipping on Biomarker Expression and Muscle Function in Mdx Mice The objective of this study was to determine the effect of a single dose of anti-mouse TfR Fab conjugated to an antisense oligonucleotide (Ab-ASO) or of a single dose of the same naked ASO on dystrophin expression and muscle function in mdx mice. The complex used in this example was DTX-C-042 as described in Example 5.

Seven-week-old male mdx homozygous mice were allocated randomly to each of eight treatment groups. The mice were administered via tail vein a singled dose of ASO at 30 mg/kg, Ab-ASO at a dose equivalent to 30 mg/kg of ASO, or saline. Tissues were harvested and analyzed 2 weeks or 4 weeks following administration.

Measurement of exon 23 skipping in muscles: Quantification of exon 23 skipping was performed using a single-step RT-PCR reaction using the SuperScript® III (Thermo Fisher) with 75 ng total RNA input. The PCR primers used were 5'-CACATCTTTGATGGTGTGAGG (forward) (SEQ ID NO: 2264) and 5'-CAACTTCAGCCATCCATTTCTG (reverse) (SEQ ID NO: 2253). Capillary electrophoresis was used to quantitate the skipped and unskipped bands in the skeletal muscles of interest using the following equation:

$$\% \text{ Exon 23 Skipping} = \frac{\text{Skipped Band}}{\text{Skipped Band} + \text{Unskipped Band}} \times 100.$$

Figure 21A:
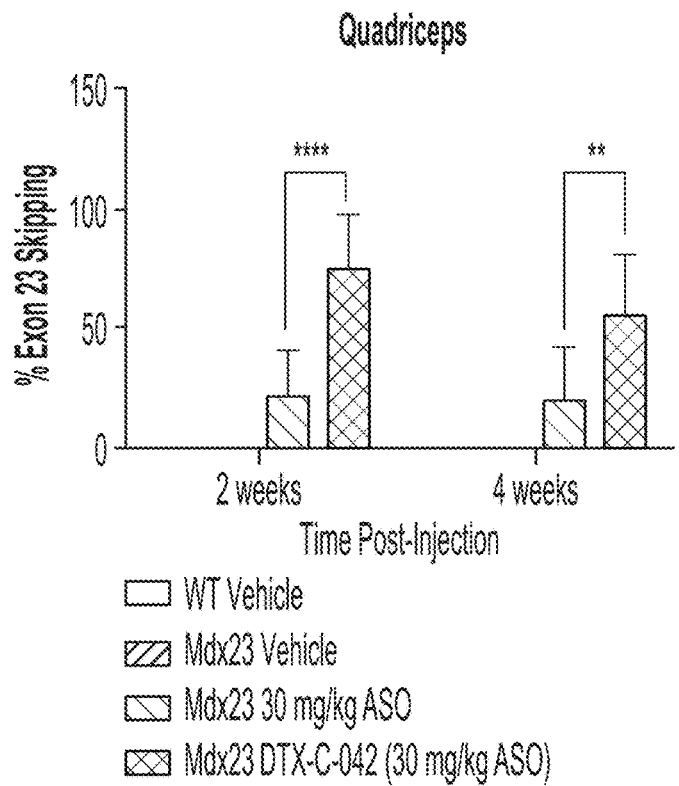
FIGS. 21A-21C show quantification of exon 23 skipping in quadriceps (FIG. 21A), heart (FIG. 21B), and diaphragm (FIG. 21C) of wild-type (WT) and mdx mice two- or four-weeks following administration of a single dose of saline, unconjugated oligonucleotide (ASO) that induces exon 23 skipping in DMD, or conjugates containing an anti-TfR RI7217 Fab conjugated to the ASO (Ab-ASO). Little or no exon 23 skipping was observed in tissues from WT mice or from mdx mice administered saline or unconjugated ASO, whereas significant levels of exon 23 skipping was observed in tissues of mdx mice treated with Ab-ASO. ($*p<0.05$, $p<0.01$, $**p<0.0001$)
Figure 21B:
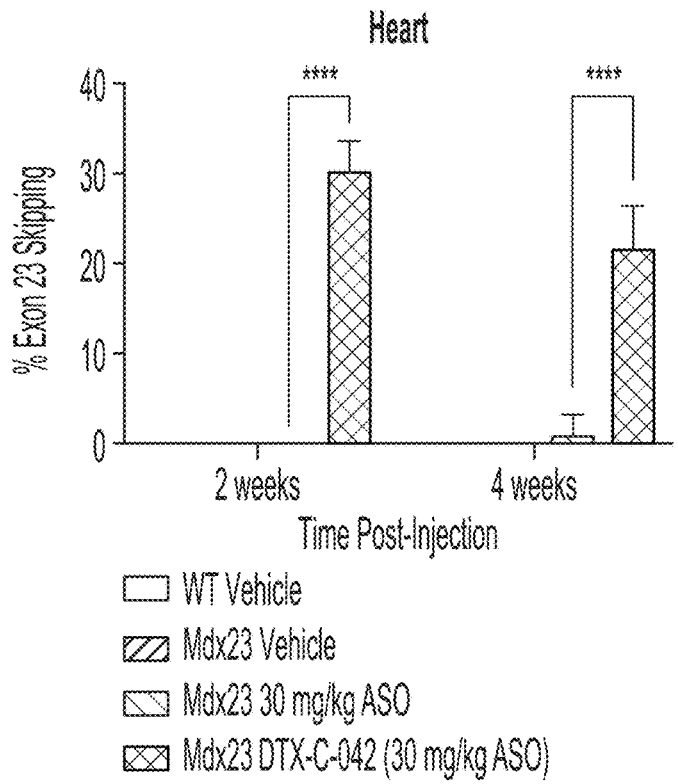
Figure 21C:
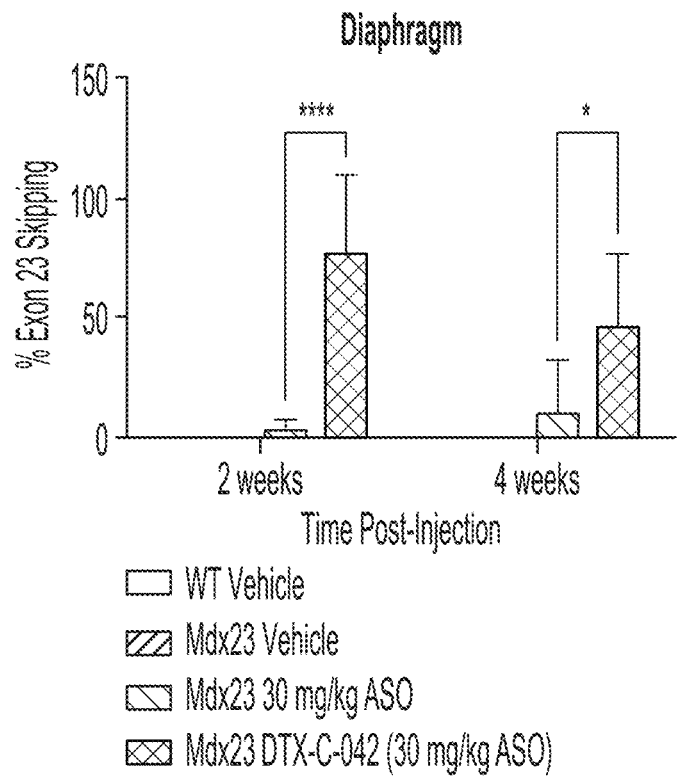

The results demonstrate that a single administration of anti-TfR Fab-oligonucleotide conjugate (Ab-ASO) facilitated significant increases in skipping of exon 23 in quadriceps (FIG. 21A), heart (FIG. 21B), and diaphragm (FIG. 21C) of mdx mice. By contrast, little or no exon 23 skipping was observed in the same muscle tissues in wild-type (WT) mice or in mdx mice treated with saline or naked ASO.

Figure 22A:
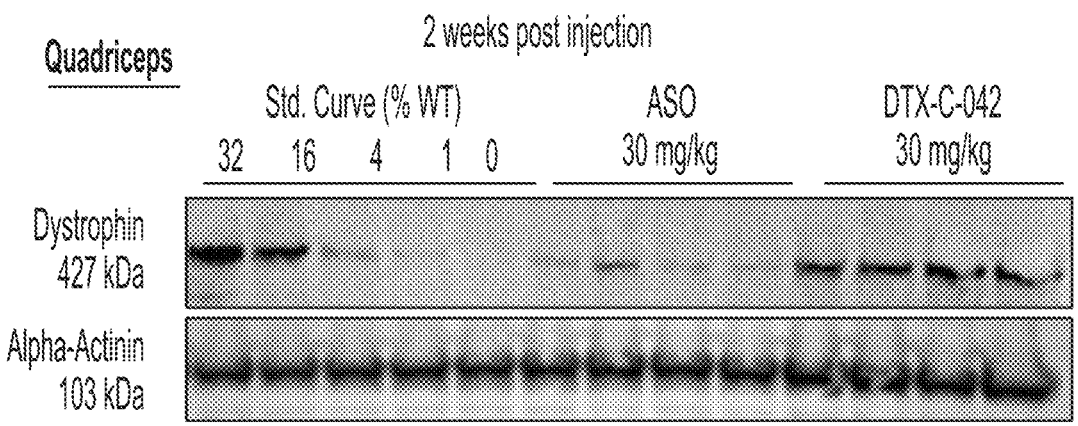
FIGS. 22A-22D show measurement of dystrophin protein in quadriceps of mdx mice following administration of a single dose of unconjugated oligonucleotide (ASO) that induces exon 23 skipping in DMD, or conjugates containing an anti-TfR1 RI7217 Fab conjugated to the ASO (Ab-ASO).
Figure 22B:
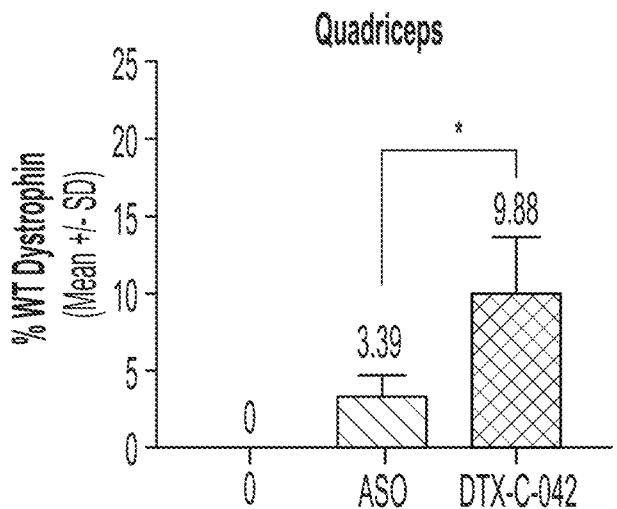
Figure 22C:
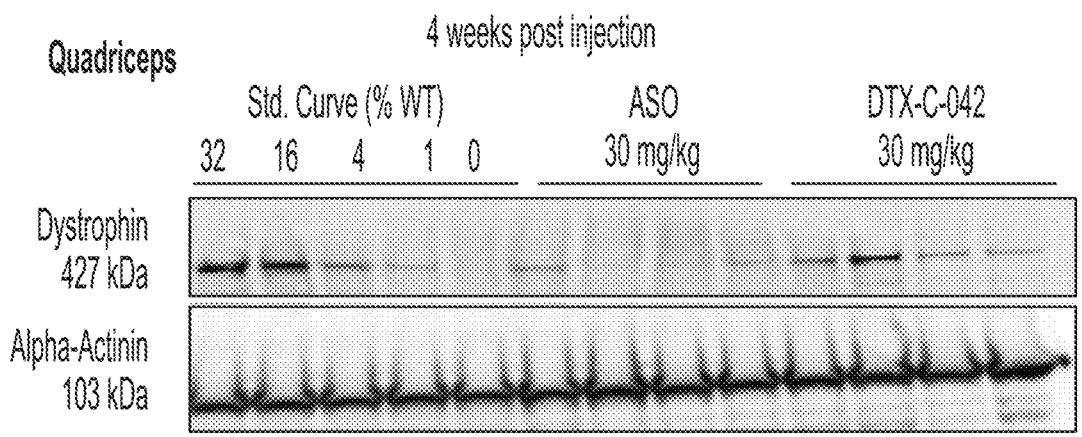
Figure 22D:
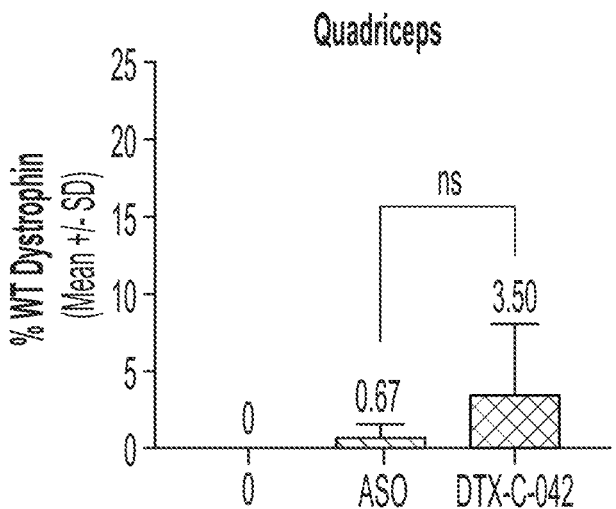
Figure 23A:
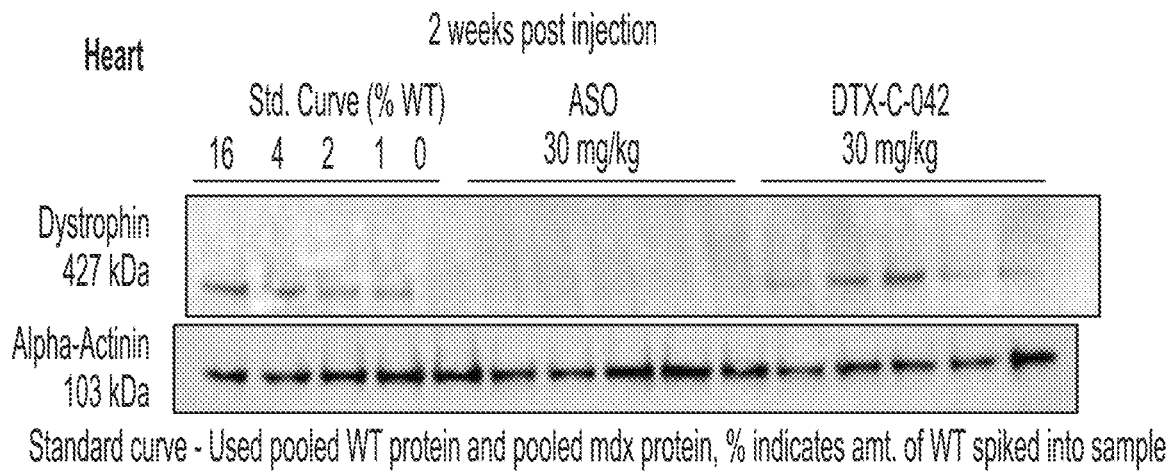
FIGS. 23A-23D show measurement of dystrophin protein in heart muscle of mdx mice following administration of a single dose of unconjugated oligonucleotide (ASO) that induces exon 23 skipping in DMD, or conjugates containing an anti-TfR1 RI7217 Fab conjugated to the ASO (Ab-ASO).
Figure 23B:
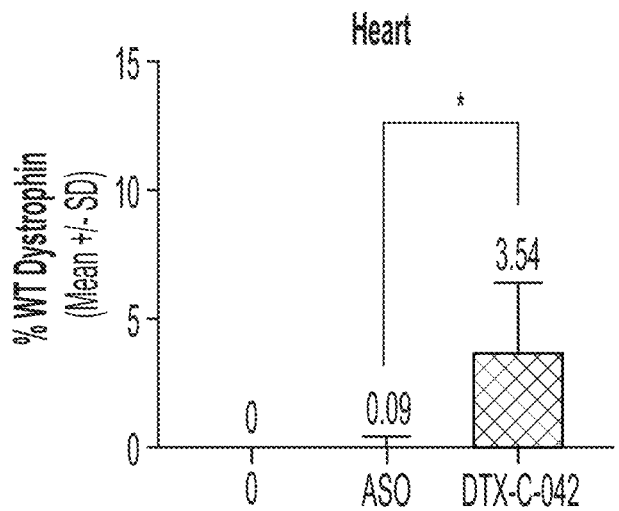
Figure 23C:
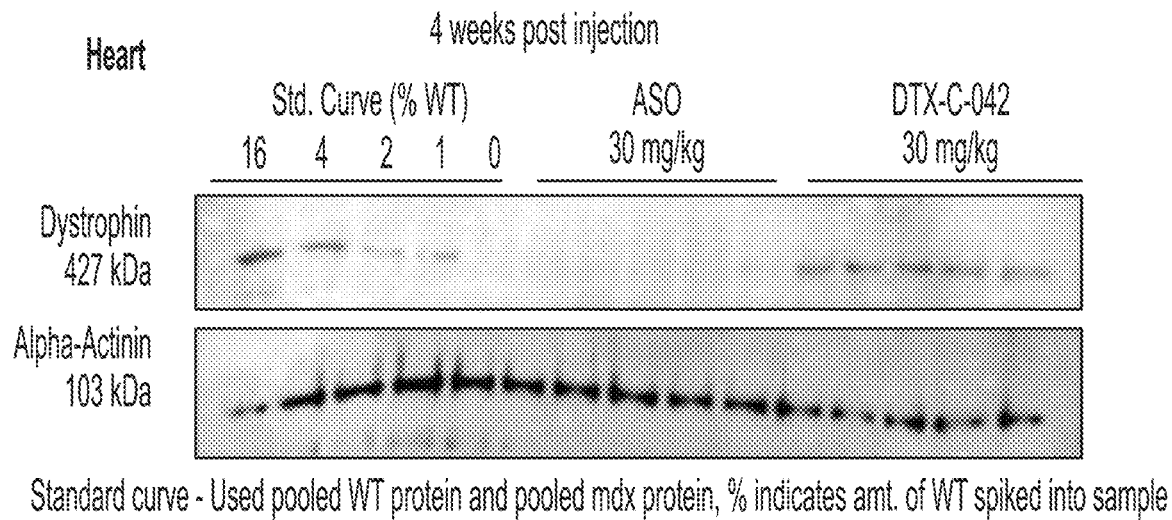
Figure 23D:
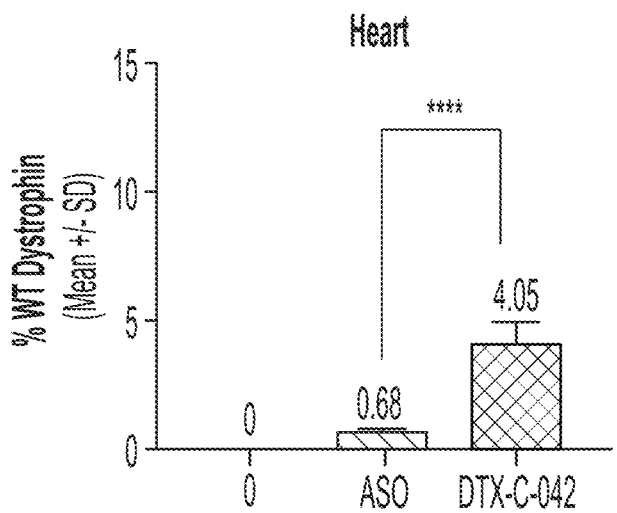
Figure 24A:
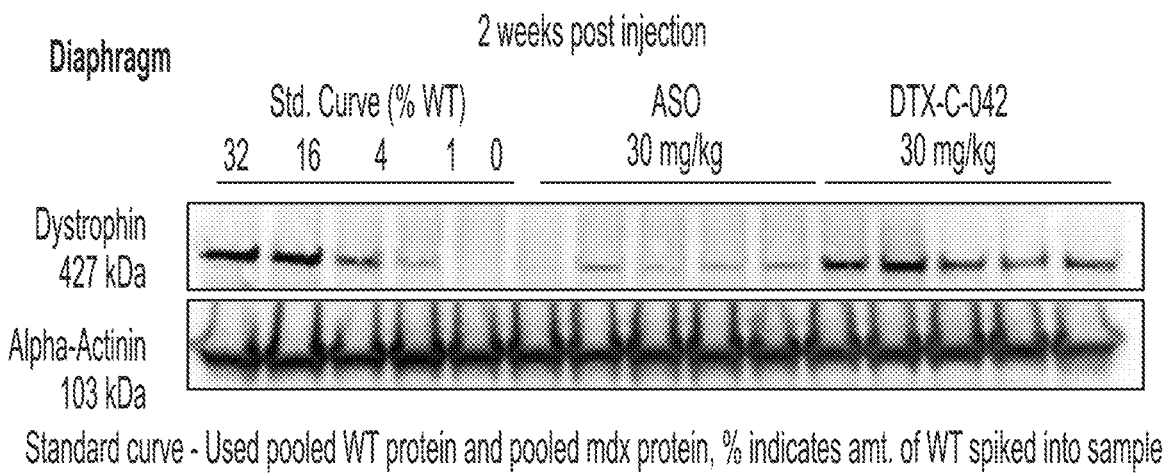
FIGS. 24A-24D show measurement of dystrophin protein in diaphragm muscle of mdx mice following administration of a single dose of unconjugated oligonucleotide (ASO) that induces exon 23 skipping in DMD, or conjugates containing an anti-TfR1 RI7217 Fab conjugated to the ASO (Ab-ASO).
Figure 24B:
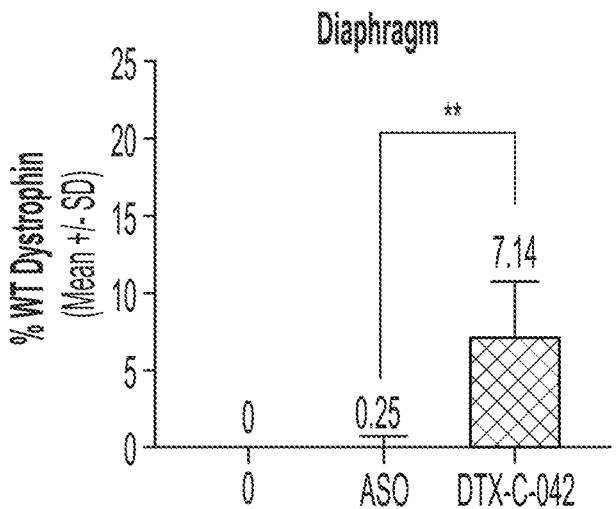
Figure 24C:
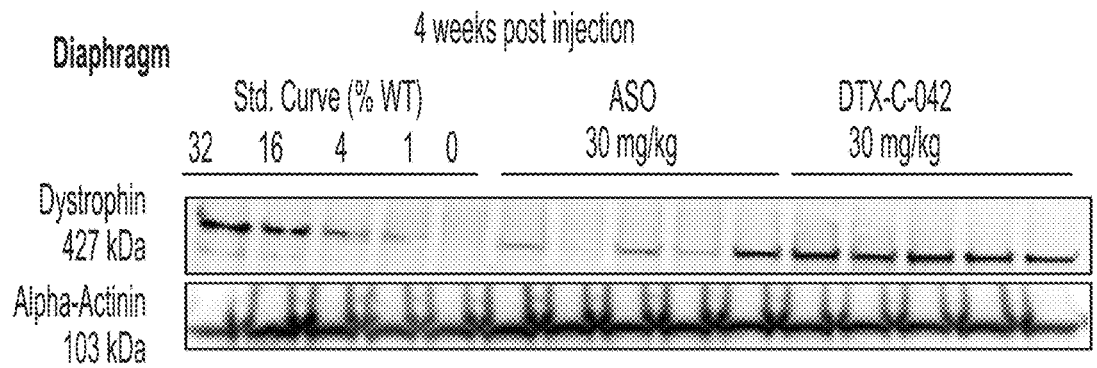
Figure 24D:
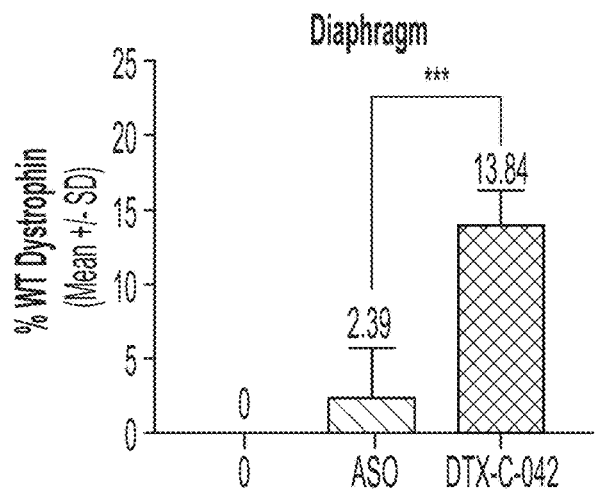

Measurement of dystrophin protein in muscles: Muscle tissue samples taken from the quadriceps were homogenized and protein concentrations were measured by BCA assay. Total protein (25 µg) was loaded onto a 3% to 8% Tris-acetate protein gel and run at 150 V for 1 hour. The gel was then transferred to a polyvinylidene difluoride membrane, and the membrane was cut, and the portion containing dystrophin was incubated overnight in anti-dystrophin antibody (Abcam catalog #15277) at 4° C., followed by goat anti-rabbit IgG (H+L) horseradish peroxidase conjugate (Bio-Rad) for 30 minutes at room temperature. As a control, the remaining portion of the blot was incubated overnight with anti-alpha-actinin antibody (Abcam catalog #9465) at 4° C., followed by goat anti-mouse IgG (H+L) horseradish peroxidase conjugate (Bio-Rad) for 15 minutes at room temperature. The blot was developed using the ECL Western Detection Kit (Cytiva) and quantified using iBright analysis software (Thermo Fisher Scientific). Images of Western blots are shown for muscle tissues collected two-weeks following injections in FIGS. 22A (quadriceps), 23A (heart), and 24A (diaphragm), and quantification of the Western blot results are shown in FIGS. 22B (quadriceps), 23B (heart), and 24B (diaphragm). Images of western blots are shown for muscle tissues collected four-weeks following injections in FIGS. 22C (quadriceps), 23C (heart), and 25C (diaphragm), and quantification of the Western blot results are shown in FIGS. 22D (quadriceps), 23D (heart), and 24D (diaphragm). In each western blot, the standard curve was generated using pooled protein from wild-type and mdx tissues, and the percentage wild-type (% WT) protein in each standard indicates the amount of wild-type protein in the sample. FIGS. 22A-22D demonstrate that two- and four-weeks following administration, Ab-ASO facilitated increases in dystrophin protein in quadriceps to a greater extent than unconjugated ASO. FIGS. 23A-23D demonstrate that two- and four-weeks following administration, Ab-ASO facilitated increases in dystrophin protein in heart muscle, whereas little to no wild-type dystrophin was measured in heart muscle from mice treated with naked ASO. FIGS. 24A-24D demonstrate that two- and four-weeks following administration, Ab-ASO facilitated increases in dystrophin protein in diaphragm muscle, whereas little to no wild-type dystrophin was measured in diaphragm muscle from mice treated with naked ASO.

Figure 25A:
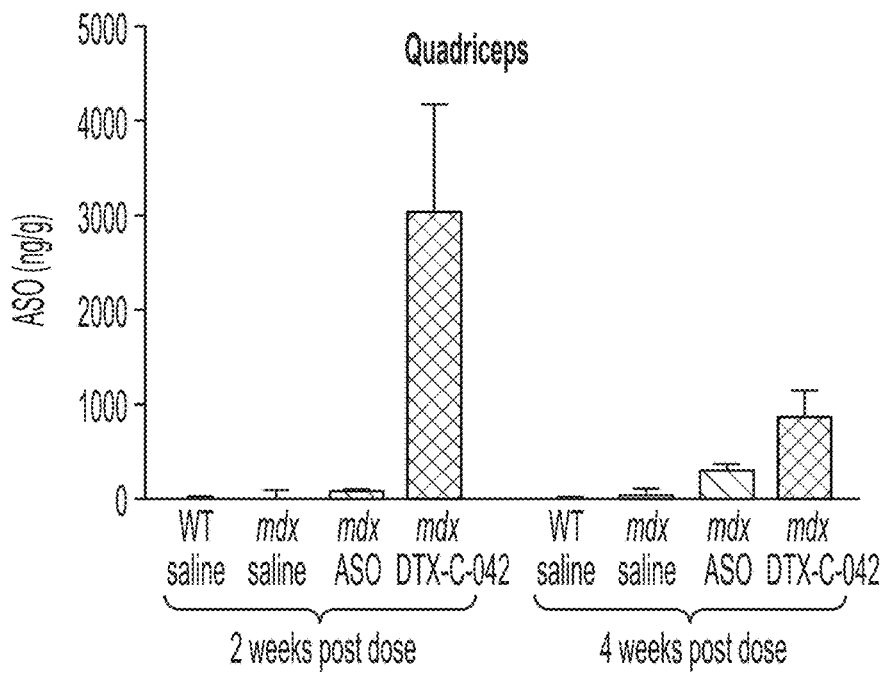
FIGS. 25A-25C show quantification of the amount of administered oligonucleotide (ASO) in quadriceps (FIG. 25A), diaphragm (FIG. 25B), and heart (FIG. 25C) of wild-type (WT) or mdx mice two- or four-weeks following administration of a single dose of saline, unconjugated exon 23 skipping oligonucleotide (ASO), or conjugates containing an anti-TfR1 RI7217 Fab conjugated to the ASO (Ab-ASO).
Figure 25B:
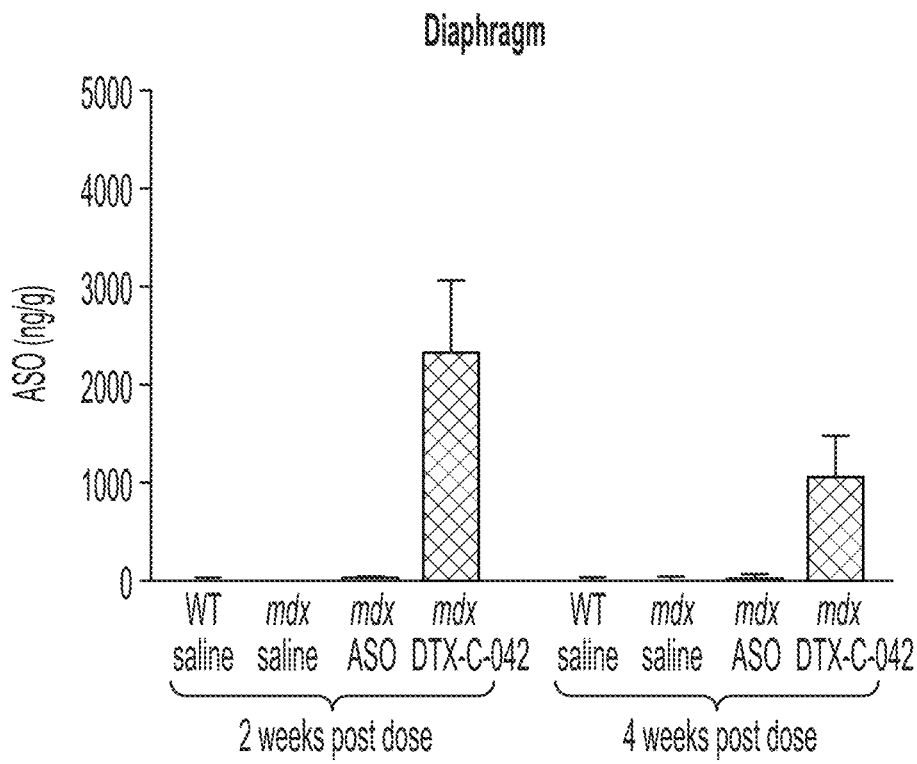
Figure 25C:
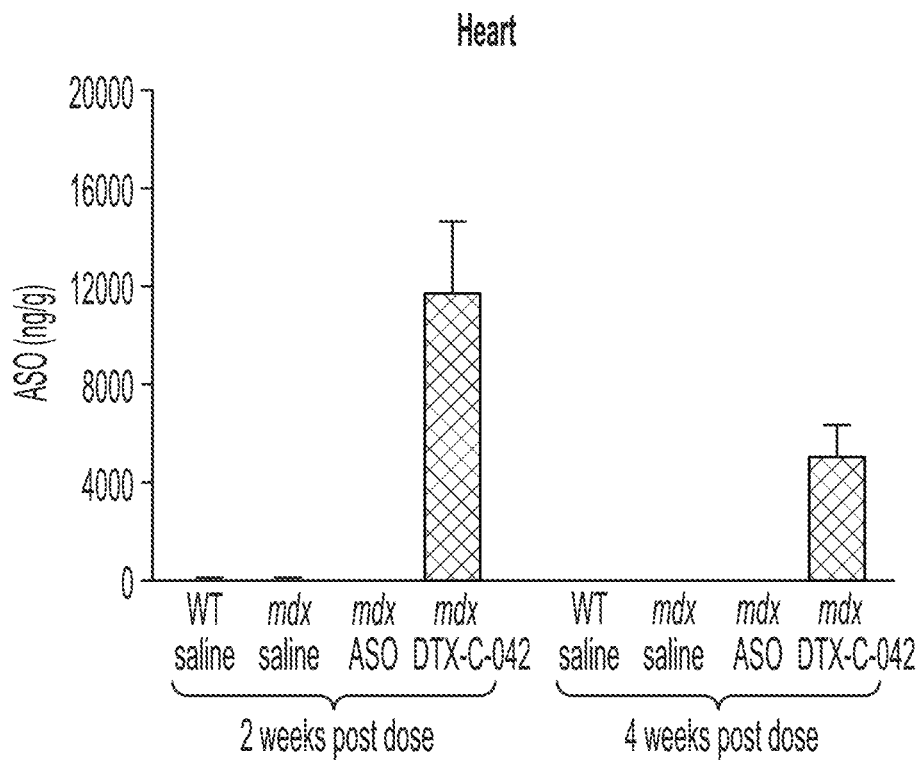

Measurement of ASO content within tissues: Enzyme-linked immunosorbent assay (ELISA) was performed by coating NeutrAvidin coated plates with a capture probe specific to the ASO of interest. Proteinase K digested tissue lysate was incubated on the coated plates to allow binding of the ASO of interest to the capture probe. Plates were then washed and unbound capture probe was digested with micrococcal nuclease, followed by further washing and blocking. A Digoxigenin HRP-conjugated antibody was added to bind to intact capture probe, then imaged using TMB substrate (R&D Systems, Inc.). Quantification was performed using a standard curve of known concentration diluted into skeletal muscle matrix. The results demonstrate that administration of the Fab conjugate is able to achieve substantial accumulation of ASO within quadriceps (FIG. 25A), diaphragm (FIG. 25B), and heart (FIG. 25C), whereas administration of naked ASO showed little or no ASO content in each muscle tissue. These results demonstrate that little or no ASO was detected in muscle tissues of mice administered saline or naked ASO, whereas administration of Ab-ASO resulted in measurable quantities of ASO in each of the tissues tested two- and four-weeks following administration.

Example 19. Conjugation of DMD Exon 53-Skipping Oligonucleotides to Anti-TfR1 Antibodies Improves their Potency To test the effect of anti-TfR1 targeting on exon 53-skipping oligonucleotides, complexes were formed comprising an anti-TfR1 Fab antibody (3M12 VH4/Vk3) covalently linked to exon 53-skipping PMOs via a linker having the structure of formula (C). Two exon 53-skipping PMOs were used in this Example: exon 53 PMO-A, comprising the sequence GTTGCCTCCGGTTCTGAAGGTGTTC (SEQ ID NO: 2256), and exon 53 PMO-B, comprising the sequence CCTCCGGTTCTGAAGGTGTTC (SEQ ID NO: 2257).

Figure 26:
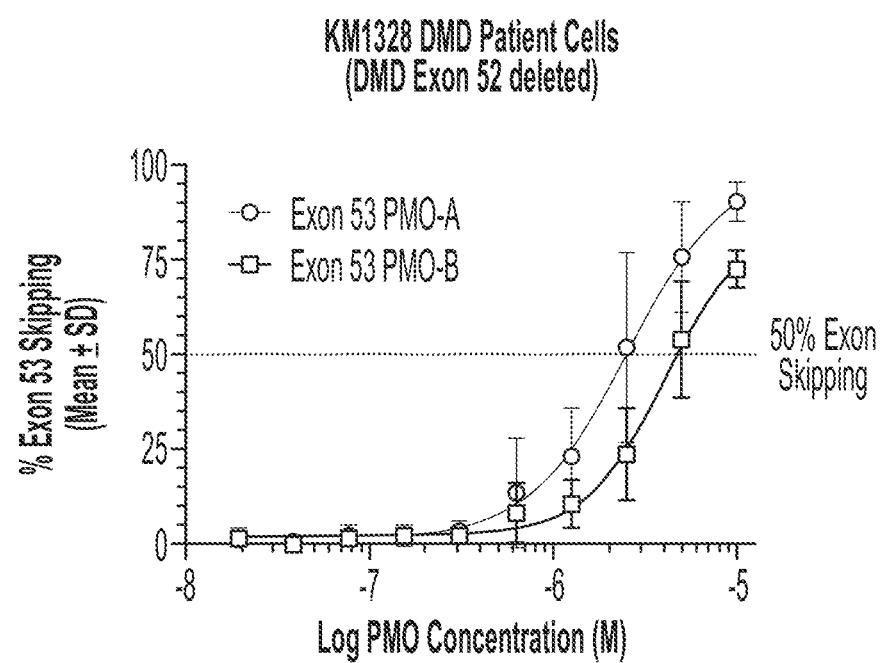
FIG. 26 shows % exon 53 skipping in DMD patient cells harboring a deletion of DMD exon 52, following gymnotic uptake of exon 53-skipping oligonucleotides over a range of concentrations.

First, the exon 53-skipping PMOs alone were tested for their ability to facilitate skipping of exon 53 following gymnotic uptake (i.e., without transfection agent or modification to confer muscle targeting). KM1328 DMD patient cells which harbor a deletion of DMD exon 52 were treated with a range of concentrations of exon 53 PMO-A or exon 53 PMO-B, and exon 53 skipping was measured. As shown in FIG. 26, exon 53 PMO-A was about 2-fold more potent than exon 53 PMO-B. Based on the dose response curves, it was calculated that a concentration of 2.5 µM of exon 53 PMO-A or 4.7 µM of exon 53 PMO-B is required to achieve 50% skipping of exon 53.

Figure 27:
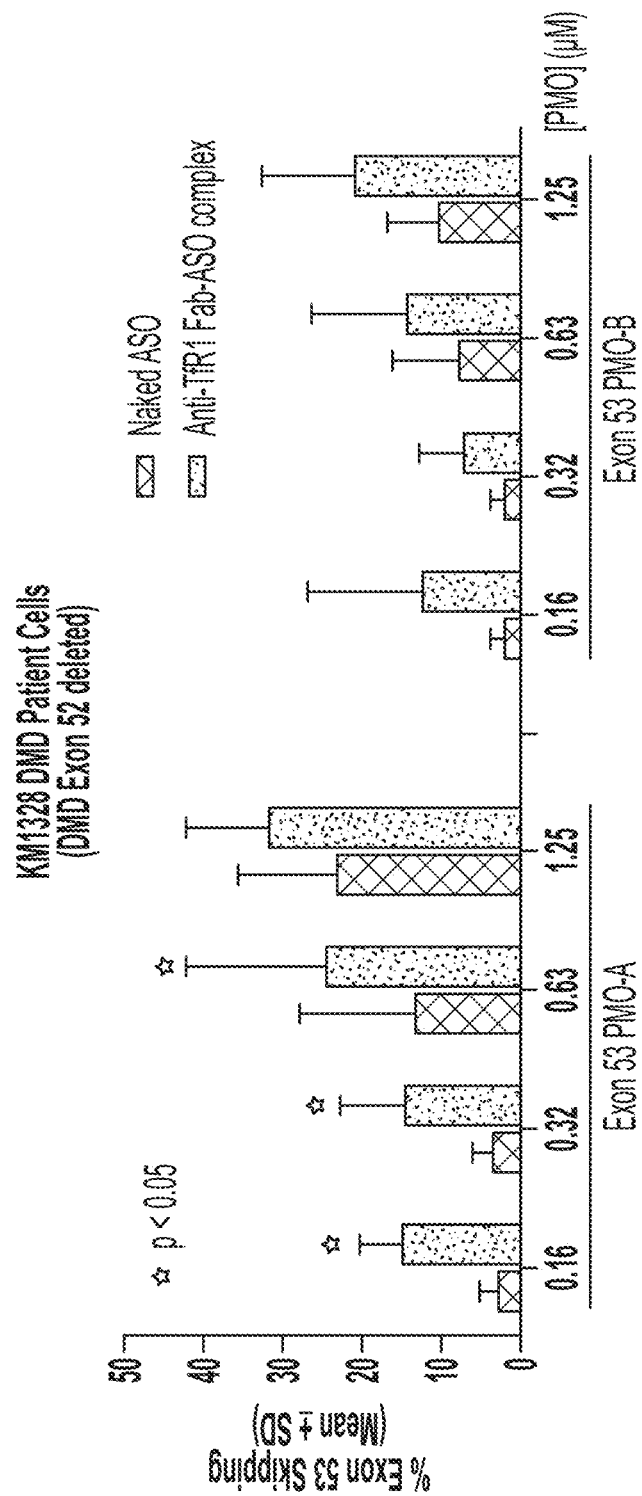
FIG. 27 shows % exon 53 skipping in DMD patient cells harboring a deletion of DMD exon 52, following treatment with exon 53-skipping PMO either not linked to an antibody ("Naked ASO") or covalently linked to an anti-TfR1 Fab ("Anti-TfR1 Fab-ASO complex") at a variety of concentrations.

Next, complexes comprising the anti-TfR1 Fab covalently linked to either exon 53 PMO-A or exon 53 PMO-B ("anti-TfR1 Fab-ASO complex") were tested for their ability to facilitate skipping of exon 53 in KM1328 DMD patient cells in comparison with the same PMOs not linked to an antibody ("naked ASO"). Cells were treated with the naked ASO at concentrations of 0.16 µM, 0.32 µM, 0.63 µM, or 1.25 µM, or with the anti-TfR1 Fab-ASO complex at ASO equivalent concentrations of 0.16 µM, 0.32 µM, 0.63 µM, or 1.25 µM. As shown in FIG. 27, the Fab-ASO complexes achieved greater exon 53 skipping than did the naked ASO at each of the tested concentrations, including achieving significantly improved exon 53 skipping by exon 53 PMO-A at the lower doses tested (0.16 µM, 0.32 µM, and 0.63 µM). These results demonstrate that covalently linking exon-skipping oligonucleotides to anti-TfR 1 antibodies can facilitate exon-skipping activity at lower doses, thereby enabling efficacy of the oligonucleotides at lower doses.

Additional Embodiments

1. A complex comprising a muscle-targeting agent covalently linked to a molecular payload configured for promoting the expression or activity of a DMD gene, wherein the muscle-targeting agent specifically binds to an internalizing cell surface receptor on muscle cells, wherein the muscle targeting agent is a humanized antibody, wherein the antibody comprises:
  (i) a heavy chain variable region (VH) comprising an amino acid sequence at least 85% identical to SEQ ID NO: 69; and/or a light chain variable region (VL) comprising an amino acid sequence at least 85% identical to SEQ ID NO: 70;
  (ii) a heavy chain variable region (VH) comprising an amino acid sequence at least 85% identical to SEQ ID NO: 71; and/or a light chain variable region (VL) comprising an amino acid sequence at least 85% identical to SEQ ID NO: 70;
  (iii) a heavy chain variable region (VH) comprising an amino acid sequence at least 85% identical to SEQ ID NO: 72; and/or a light chain variable region (VL) comprising an amino acid sequence at least 85% identical to SEQ ID NO: 70;
  (iv) a heavy chain variable region (VH) comprising an amino acid sequence at least 85% identical to SEQ ID NO: 73; and/or a light chain variable region (VL) comprising an amino acid sequence at least 85% identical to SEQ ID NO: 74;
  (v) a heavy chain variable region (VH) comprising an amino acid sequence at least 85% identical to SEQ ID NO: 73; and/or a light chain variable region (VL) comprising an amino acid sequence at least 85% identical to SEQ ID NO: 75;
  (vi) a heavy chain variable region (VH) comprising an amino acid sequence at least 85% identical to SEQ ID NO: 76; and/or a light chain variable region (VL) comprising an amino acid sequence at least 85% identical to SEQ ID NO: 74;
  (vii) a heavy chain variable region (VH) comprising an amino acid sequence at least 85% identical to SEQ ID NO: 76; and/or a light chain variable region (VL) comprising an amino acid sequence at least 85% identical to SEQ ID NO: 75;
  (viii) a heavy chain variable region (VH) comprising an amino acid sequence at least 85% identical to SEQ ID NO: 77; and/or a light chain variable region (VL) comprising an amino acid sequence at least 85% identical to SEQ ID NO: 78;
  (ix) a heavy chain variable region (VH) comprising an amino acid sequence at least 85% identical to SEQ ID NO: 79; and/or a light chain variable region (VL) comprising an amino acid sequence at least 85% identical to SEQ ID NO: 80; or
  (x) a heavy chain variable region (VH) comprising an amino acid sequence at least 85% identical to SEQ ID NO: 77; and/or a light chain variable region (VL) comprising an amino acid sequence at least 85% identical to SEQ ID NO: 80.

2. The complex of embodiment 1, wherein the antibody comprises:
  (i) a VH comprising the amino acid sequence of SEQ ID NO: 69 and a VL comprising the amino acid sequence of SEQ ID NO: 70;
  (ii) a VH comprising the amino acid sequence of SEQ ID NO: 71 and a VL comprising the amino acid sequence of SEQ ID NO: 70;
  (iii) a VH comprising the amino acid sequence of SEQ ID NO: 72 and a VL comprising the amino acid sequence of SEQ ID NO: 70;
  (iv) a VH comprising the amino acid sequence of SEQ ID NO: 73 and a VL comprising the amino acid sequence of SEQ ID NO: 74;
  (v) a VH comprising the amino acid sequence of SEQ ID NO: 73 and a VL comprising the amino acid sequence of SEQ ID NO: 75;
  (vi) a VH comprising the amino acid sequence of SEQ ID NO: 76 and a VL comprising the amino acid sequence of SEQ ID NO: 74;
  (vii) a VH comprising the amino acid sequence of SEQ ID NO: 76 and a VL comprising the amino acid sequence of SEQ ID NO: 75;

(viii) a VH comprising the amino acid sequence of SEQ ID NO: 77 and a VL comprising the amino acid sequence of SEQ ID NO: 78;
(ix) a VH comprising the amino acid sequence of SEQ ID NO: 79 and a VL comprising the amino acid sequence of SEQ ID NO: 80; or
(x) a VH comprising the amino acid sequence of SEQ ID NO: 77 and a VL comprising the amino acid sequence of SEQ ID NO: 80.

3. The complex of embodiment 1 or embodiment 2, wherein the antibody is selected from the group consisting of a full-length IgG, a Fab fragment, a Fab' fragment, a F(ab')2 fragment, a scFv, and a Fv.

4. The complex of embodiment 3, wherein the antibody is a full-length IgG, optionally wherein the full-length IgG comprises a heavy chain constant region of the isotype IgG1, IgG2, IgG3, or IgG4.

5. The complex of embodiment 4, wherein the antibody comprises:
(i) a heavy chain comprising an amino acid sequence at least 85% identical to SEQ ID NO: 84; and/or a light chain comprising an amino acid sequence at least 85% identical to SEQ ID NO: 85;
(ii) a heavy chain comprising an amino acid sequence at least 85% identical to SEQ ID NO: 86; and/or a light chain comprising an amino acid sequence at least 85% identical to SEQ ID NO: 85;
(iii) a heavy chain comprising an amino acid sequence at least 85% identical to SEQ ID NO: 87; and/or a light chain comprising an amino acid sequence at least 85% identical to SEQ ID NO: 85;
(iv) a heavy chain comprising an amino acid sequence at least 85% identical to SEQ ID NO: 88; and/or a light chain comprising an amino acid sequence at least 85% identical to SEQ ID NO: 89;
(v) a heavy chain comprising an amino acid sequence at least 85% identical to SEQ ID NO: 88; and/or a light chain comprising an amino acid sequence at least 85% identical to SEQ ID NO: 90;
(vi) a heavy chain comprising an amino acid sequence at least 85% identical to SEQ ID NO: 91; and/or a light chain comprising an amino acid sequence at least 85% identical to SEQ ID NO: 89;
(vii) a heavy chain comprising an amino acid sequence at least 85% identical to SEQ ID NO: 91; and/or a light chain comprising an amino acid sequence at least 85% identical to SEQ ID NO: 90;
(viii) a heavy chain comprising an amino acid sequence at least 85% identical to SEQ ID NO: 92; and/or a light chain comprising an amino acid sequence at least 85% identical to SEQ ID NO: 93;
(ix) a heavy chain comprising an amino acid sequence at least 85% identical to SEQ ID NO: 94; and/or a light chain comprising an amino acid sequence at least 85% identical to SEQ ID NO: 95; or
(x) a heavy chain comprising an amino acid sequence at least 85% identical to SEQ ID NO: 92; and/or a light chain comprising an amino acid sequence at least 85% identical to SEQ ID NO: 95.

6. The complex of embodiment 3, wherein the antibody is a Fab fragment.

7. The complex of embodiment 6, wherein the antibody comprises:
(i) a heavy chain comprising an amino acid sequence at least 85% identical to SEQ ID NO: 97; and/or a light chain comprising an amino acid sequence at least 85% identical to SEQ ID NO: 85;
(ii) a heavy chain comprising an amino acid sequence at least 85% identical to SEQ ID NO: 98; and/or a light chain comprising an amino acid sequence at least 85% identical to SEQ ID NO: 85;
(iii) a heavy chain comprising an amino acid sequence at least 85% identical to SEQ ID NO: 99; and/or a light chain comprising an amino acid sequence at least 85% identical to SEQ ID NO: 85;
(iv) a heavy chain comprising an amino acid sequence at least 85% identical to SEQ ID NO: 100; and/or a light chain comprising an amino acid sequence at least 85% identical to SEQ ID NO: 89;
(v) a heavy chain comprising an amino acid sequence at least 85% identical to SEQ ID NO: 100; and/or a light chain comprising an amino acid sequence at least 85% identical to SEQ ID NO: 90;
(vi) a heavy chain comprising an amino acid sequence at least 85% identical to SEQ ID NO: 101; and/or a light chain comprising an amino acid sequence at least 85% identical to SEQ ID NO: 89;
(vii) a heavy chain comprising an amino acid sequence at least 85% identical to SEQ ID NO: 101; and/or a light chain comprising an amino acid sequence at least 85% identical to SEQ ID NO: 90;
(viii) a heavy chain comprising an amino acid sequence at least 85% identical to SEQ ID NO: 102; and/or a light chain comprising an amino acid sequence at least 85% identical to SEQ ID NO: 93;
(ix) a heavy chain comprising an amino acid sequence at least 85% identical to SEQ ID NO: 103; and/or a light chain comprising an amino acid sequence at least 85% identical to SEQ ID NO: 95; or
(x) a heavy chain comprising an amino acid sequence at least 85% identical to SEQ ID NO: 102; and/or a light chain comprising an amino acid sequence at least 85% identical to SEQ ID NO: 95.

8. The complex of embodiment 6 or embodiment 7, wherein the antibody comprises:
(i) a heavy chain comprising the amino acid sequence of SEQ ID NO: 97; and a light chain comprising the amino acid sequence of SEQ ID NO: 85;
(ii) a heavy chain comprising the amino acid sequence of SEQ ID NO: 98; and a light chain comprising the amino acid sequence of SEQ ID NO: 85;
(iii) a heavy chain comprising the amino acid sequence of SEQ ID NO: 99; and a light chain comprising the amino acid sequence of SEQ ID NO: 85;
(iv) a heavy chain comprising the amino acid sequence of SEQ ID NO: 100; and a light chain comprising the amino acid sequence of SEQ ID NO: 89;
(v) a heavy chain comprising the amino acid sequence of SEQ ID NO: 100; and a light chain comprising the amino acid sequence of SEQ ID NO: 90;
(vi) a heavy chain comprising the amino acid sequence of SEQ ID NO: 101; and a light chain comprising the amino acid sequence of SEQ ID NO: 89;
(vii) a heavy chain comprising the amino acid sequence of SEQ ID NO: 101; and a light chain comprising the amino acid sequence of SEQ ID NO: 90;
(viii) a heavy chain comprising the amino acid sequence of SEQ ID NO: 102; and a light chain comprising the amino acid sequence of SEQ ID NO: 93;
(ix) a heavy chain comprising the amino acid sequence of SEQ ID NO: 103; and a light chain comprising the amino acid sequence of SEQ ID NO: 95; or
(x) a heavy chain comprising the amino acid sequence of SEQ ID NO: 102; and a light chain comprising the amino acid sequence of SEQ ID NO: 95.

9. The complex of any one of embodiments 1 to 8, wherein the equilibrium dissociation constant ($K_D$) of binding of the antibody to the transferrin receptor is in a range from $10^{-11}$ M to $10^{-6}$ M.

10. The complex of any one of embodiments 1 to 9, wherein the antibody does not specifically bind to the transferrin binding site of the transferrin receptor and/or wherein the muscle-targeting antibody does not inhibit binding of transferrin to the transferrin receptor.

11. The complex of any one of embodiments 1 to 10, wherein the antibody is cross-reactive with extracellular epitopes of two or more of a human, non-human primate and rodent transferrin receptor.

12. The complex of any one of embodiments 1 to 11, wherein the complex is configured to promote transferrin receptor mediated internalization of the molecular payload into a muscle cell.

13. The complex of any one of embodiments 1 to 12, wherein the antibody is a chimeric antibody, optionally wherein the chimeric antibody is a humanized monoclonal antibody.

14. The complex of any one of embodiments 1 to 13, wherein the antibody is in the form of a ScFv, Fab fragment, Fab' fragment, F(ab')$_2$ fragment, or Fv fragment.

15. The complex of any one of embodiments 1 to 14, wherein the molecular payload is an oligonucleotide.

16. The complex of embodiment 15, wherein the oligonucleotide comprises a sequence listed in Table 14.

16.1. The complex of embodiment 15, wherein the oligonucleotide comprises any one of SEQ ID NO: 437-1241, or is complementary to any one of SEQ ID NO: 1242-2046.

17. The complex of embodiment 16 or embodiment 16.1, wherein the oligonucleotide comprises a region of complementarity to a mutated DMD allele.

18. The complex of any one of embodiments 1 to 14, wherein the molecular payload is a polypeptide.

19. The complex of embodiment 18, wherein the polypeptide is a functional fragment of dystrophin protein.

20 The complex of any one of embodiments 15 to 17, wherein the oligonucleotide is configured to suppress a truncating mutation in a DMD allele by mono- or multi-exon skipping.

21. The complex of any one of embodiments 15 to 17, wherein the oligonucleotide promotes antisense-mediated exon skipping to produce in-frame dystrophin mRNA.

22. The complex of embodiment 21, wherein the oligonucleotide promotes skipping of an exon of DMD in the range of exon 8 to exon 55, optionally exon 23 to exon 53.

23. The complex of embodiment 22, wherein the oligonucleotide promotes skipping of exon 8, exon 23, exon 44, exon 45, exon 50, exon 51, exon 52, exon 53, and/or exon 55.

24. The complex of embodiment 21, wherein the oligonucleotide promotes skipping of exon 51.

25. The complex of embodiment 24, wherein the oligonucleotide promotes skipping of multiple exons in the range of exon 44 to exon 53.

26. The complex of any one of embodiments 15 to 17 or 20 to 25, wherein the oligonucleotide comprises at least one modified internucleotide linkage.

27. The complex of embodiment 26, wherein the at least one modified internucleotide linkage is a phosphorothioate linkage.

28. The complex of embodiment 27, wherein the oligonucleotide comprises phosphorothioate linkages in the Rp stereochemical conformation and/or in the Sp stereochemical conformation.

29. The complex of embodiment 28, wherein the oligonucleotide comprises phosphorothioate linkages that are all in the Rp stereochemical conformation or that are all in the Sp stereochemical conformation.

30. The complex of any one of embodiments 15 to 17 or 20 to 29, wherein the oligonucleotide comprises one or more modified nucleotides.

31. The complex of embodiment 30, wherein the one or more modified nucleotides are 2'-modified nucleotides.

32. The complex of any one of embodiments 15 to 17 or 20 to 31, wherein the oligonucleotide is a gapmer oligonucleotide that directs RNAse H-mediated cleavage of an miRNA that negatively regulates DMD expression in a cell, optionally wherein the miRNA is miR-31.

33. The complex of embodiment 32, wherein the gapmer oligonucleotide comprises a central portion of 5 to 15 deoxyribonucleotides flanked by wings of 2 to 8 modified nucleotides.

34. The complex of embodiment 33, wherein the modified nucleotides of the wings are 2'-modified nucleotides.

35. The complex of any one of embodiments 15 to 17 or 20 to 31, wherein the oligonucleotide is a mixmer oligonucleotide.

36. The complex of embodiment 35, wherein the mixmer oligonucleotide promotes exon skipping.

37. The complex of embodiment 35 or 36, wherein the mixmer oligonucleotide comprises two or more different 2' modified nucleotides.

38. The complex of any one of embodiments 15 to 17 or 20 to 31, wherein the oligonucleotide is an RNAi oligonucleotide that promotes RNAi-mediated cleavage of an miRNA that negatively regulates DMD expression in a cell, optionally wherein the miRNA is miR-31.

39 The complex of embodiment 38, wherein the RNAi oligonucleotide is a double-stranded oligonucleotide of 19 to 25 nucleotides in length.

40. The complex of embodiment 38 or 39, wherein the RNAi oligonucleotide comprises at least one 2' modified nucleotide.

41. The complex of any one of embodiments 31, 34, 37, or 40, wherein each 2' modified nucleotide is selected from the group consisting of: 2'-O-methyl, 2'-fluoro (2'-F), 2'-O-methoxyethyl (2'-MOE), and 2', 4'-bridged nucleotides.

42. The complex of embodiment 30, wherein the one or more modified nucleotides are bridged nucleotides.

43. The complex of any one of embodiments 31, 34, 37, or 40, wherein at least one 2' modified nucleotide is a 2',4'-bridged nucleotide selected from: 2',4'-constrained 2'-O-ethyl (cEt) and locked nucleic acid (LNA) nucleotides.

44. The complex of any one of embodiments 15 to 17 or 20 to 31, wherein the oligonucleotide comprises a guide sequence for a genome editing nuclease.

45. The complex of any one of embodiments 15 to 17 or 20 to 31, wherein the oligonucleotide is phosphorodiamidate morpholino oligomer.

46. The complex of any one of embodiments 1 to 45, wherein the muscle-targeting agent is covalently linked to the molecular payload via a cleavable linker.

47. The complex of embodiment 46, wherein the cleavable linker is selected from: a protease-sensitive linker, pH-sensitive linker, and glutathione-sensitive linker.

48. The complex of embodiment 47, wherein the cleavable linker is a protease-sensitive linker.

49. The complex of embodiment 48, wherein the protease-sensitive linker comprises a sequence cleavable by a lysosomal protease and/or an endosomal protease.

50. The complex of embodiment 48, wherein the protease-sensitive linker comprises a valine-citrulline dipeptide sequence.

51. The complex of embodiment 47, wherein the linker is pH-sensitive linker that is cleaved at a pH in a range of 4 to 6.

52. The complex of any one of embodiments 1 to 45, wherein the muscle-targeting agent is covalently linked to the molecular payload via a non-cleavable linker. 53. The complex of embodiment 52, wherein the non-cleavable linker is an alkane linker.

54. The complex of any one of embodiments 1 to 53, wherein the antibody comprises a non-natural amino acid to which the oligonucleotide is covalently linked.

55. The complex of any one of embodiments 1 to 53, wherein the antibody is covalently linked to the oligonucleotide via conjugation to a lysine residue or a cysteine residue of the antibody.

56. The complex of embodiment 55, wherein the oligonucleotide is conjugated to the cysteine of the antibody via a maleimide-containing linker, optionally wherein the maleimide-containing linker comprises a maleimidocaproyl or maleimidomethyl cyclohexane-1-carboxylate group.

57. The complex of any one of embodiments 1 to 56, wherein the antibody is a glycosylated antibody that comprises at least one sugar moiety to which the oligonucleotide is covalently linked.

58. The complex of embodiment 57, wherein the sugar moiety is a branched mannose.

59. The complex of embodiment 57 or 58, wherein the antibody is a glycosylated antibody that comprises one to four sugar moieties each of which is covalently linked to a separate oligonucleotide.

60. The complex of embodiment 57, wherein the antibody is a fully-glycosylated antibody.

61. The complex of embodiment 57, wherein the antibody is a partially-glycosylated antibody.

62. The complex of embodiment 61, wherein the partially-glycosylated antibody is produced via chemical or enzymatic means.

63. The complex of embodiment 61, wherein the partially-glycosylated antibody is produced in a cell that is deficient for an enzyme in the N- or O-glycosylation pathway.

64. A method of delivering a molecular payload to a cell expressing transferrin receptor, the method comprising contacting the cell with the complex of any one of embodiments 1 to 63.

65. A method of promoting the expression or activity of a DMD protein in a cell, the method comprising contacting the cell with the complex of any one of embodiments 1 to 63 in an amount effective for promoting internalization of the molecular payload to the cell.

66. The method of embodiment 65, wherein the cell is in vitro.

67 The method of embodiment 65, wherein the cell is in a subject.

68 The method of embodiment 67, wherein the subject is a human.

69. A method of treating a subject having a mutated DMD allele that is associated with a dystrophinopathy, the method comprising administering to the subject an effective amount of the complex of any one of embodiments 1 to 63.

70. A method of promoting skipping of an exon of a DMD mRNA transcript in a cell, the method comprising administering to the cell an effective amount of the complex of any one of embodiments 1 to 63.

71. The method of embodiment 70, wherein the method promotes skipping of exon 8, exon 23, exon 44, exon 45, exon 50, exon 51, exon 52, exon 53, and/or exon 55 of the DMD mRNA transcript.

72. The method of embodiment 70 or 71, wherein the method promotes skipping of exon 51 of the DMD mRNA transcript.

73. A complex comprising an anti-transferrin receptor (TfR) antibody covalently linked to a molecular payload configured for promoting the expression or activity of a DMD gene, wherein the antibody comprises:
(i) a heavy chain variable region (VH) comprising an amino acid sequence at least 85% identical to SEQ ID NO: 76; and/or a light chain variable region (VL) comprising an amino acid sequence at least 85% identical to SEQ ID NO: 75;
(ii) a heavy chain variable region (VH) comprising an amino acid sequence at least 85% identical to SEQ ID NO: 69; and/or a light chain variable region (VL) comprising an amino acid sequence at least 85% identical to SEQ ID NO: 70;
(iii) a heavy chain variable region (VH) comprising an amino acid sequence at least 85% identical to SEQ ID NO: 71; and/or a light chain variable region (VL) comprising an amino acid sequence at least 85% identical to SEQ ID NO: 70;
(iv) a heavy chain variable region (VH) comprising an amino acid sequence at least 85% identical to SEQ ID NO: 72; and/or a light chain variable region (VL) comprising an amino acid sequence at least 85% identical to SEQ ID NO: 70;
(v) a heavy chain variable region (VH) comprising an amino acid sequence at least 85% identical to SEQ ID NO: 73; and/or a light chain variable region (VL) comprising an amino acid sequence at least 85% identical to SEQ ID NO: 74;
(vi) a heavy chain variable region (VH) comprising an amino acid sequence at least 85% identical to SEQ ID NO: 73; and/or a light chain variable region (VL) comprising an amino acid sequence at least 85% identical to SEQ ID NO: 75;
(vii) a heavy chain variable region (VH) comprising an amino acid sequence at least 85% identical to SEQ ID NO: 76; and/or a light chain variable region (VL) comprising an amino acid sequence at least 85% identical to SEQ ID NO: 74;
(viii) a heavy chain variable region (VH) comprising an amino acid sequence at least 85% identical to SEQ ID NO: 77; and/or a light chain variable region (VL) comprising an amino acid sequence at least 85% identical to SEQ ID NO: 78;
(ix) a heavy chain variable region (VH) comprising an amino acid sequence at least 85% identical to SEQ ID NO: 79; and/or a light chain variable region (VL) comprising an amino acid sequence at least 85% identical to SEQ ID NO: 80; or
(x) a heavy chain variable region (VH) comprising an amino acid sequence at least 85% identical to SEQ ID NO: 77; and/or a light chain variable region (VL) comprising an amino acid sequence at least 85% identical to SEQ ID NO: 80.

73. A complex comprising an anti-transferrin receptor (TfR) antibody covalently linked to a molecular payload configured for promoting the expression or activity of a DMD gene, wherein the anti-TfR antibody has undergone pyroglutamate formation resulting from a post-translational modification.

EQUIVALENTS AND TERMINOLOGY

The disclosure illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the disclosure. Thus, it should be understood that although the present disclosure has been specifically disclosed by preferred embodiments, optional features, modification and variation of the concepts herein disclosed may be resorted to by those skilled in the art, and that such modifications and variations are considered to be within the scope of this disclosure.

In addition, where features or aspects of the disclosure are described in terms of Markush groups or other grouping of alternatives, those skilled in the art will recognize that the disclosure is also thereby described in terms of any individual member or subgroup of members of the Markush group or other group.

It should be appreciated that, in some embodiments, sequences presented in the sequence listing may be referred to in describing the structure of an oligonucleotide or other nucleic acid. In such embodiments, the actual oligonucleotide or other nucleic acid may have one or more alternative nucleotides (e.g., an RNA counterpart of a DNA nucleotide or a DNA counterpart of an RNA nucleotide) and/or (e.g., and) one or more modified nucleotides and/or (e.g., and) one or more modified internucleotide linkages and/or (e.g., and) one or more other modification compared with the specified sequence while retaining essentially same or similar complementary properties as the specified sequence.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein. Variations of those embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

SEQUENCE LISTING (2287 sequences)

SEQ ID NO: 1 - protein, 8 aa, synthetic construct
  REGION 1..8: note = Synthetic
GFNIKDDY

SEQ ID NO: 2 - protein, 8 aa, synthetic construct
  REGION 1..8: note = Synthetic
IDPENGDT

SEQ ID NO: 3 - protein, 10 aa, synthetic construct
  REGION 1..10: note = Synthetic
TLWLRRGLDY

SEQ ID NO: 4 - protein, 11 aa, synthetic construct
  REGION 1..11: note = Synthetic
KSLLHSNGYTY

SEQ ID NO: 5 - skipped

SEQ ID NO: 6 - protein, 9 aa, synthetic construct
  REGION 1..9: note = Synthetic
MQHLEYPFT

SEQ ID NO: 7 - protein, 5 aa, synthetic construct
  REGION 1..5: note = Synthetic
DDYMY

SEQ ID NO: 8 - protein, 17 aa, synthetic construct
  REGION 1..17: note = Synthetic
WIDPENGDTEYASKFQD

SEQ ID NO: 9 - protein, 8 aa, synthetic construct
  REGION 1..8: note = Synthetic
WLRRGLDY

SEQ ID NO: 10 - protein, 16 aa, synthetic construct
  REGION 1..16: note = Synthetic
RSSKSLLHSNGYTYLF

SEQ ID NO: 11 - protein, 7 aa, synthetic construct
  REGION 1..7: note = Synthetic
RMSNLAS

SEQ ID NO: 12 - protein, 7 aa, synthetic construct
  REGION 1..7: note = Synthetic
GFNIKDD

SEQ ID NO: 13 - skipped

SEQ ID NO: 14 - protein, 6 aa, synthetic construct
  REGION 1..6: note = Synthetic
LRRGLD

SEQ ID NO: 15 - protein, 12 aa, synthetic construct
  REGION 1..12: note = Synthetic
SKSLLHSNGYTY

SEQ ID NO: 16 - protein, 6 aa, synthetic construct
  REGION 1..6: note = Synthetic
HLEYPF

SEQ ID NO: 17 - protein, 117 aa, synthetic construct
  REGION 1..117: note = Synthetic
EVQLQQSGAELVRPGASVKLSCTASGFNIKDDYMYWVKQRPEQGLEWIGWIDPENGDTEYASKFQDKATVTADTSSNTAYLQLSSLTSEDTAVYYCTLWLRRGLDYWGQGTSVTVSS

SEQ ID NO: 18 - protein, 112 aa, synthetic construct
  REGION 1..112: note = Synthetic
DIVMTQAAPSVPVTPGESVSISCRSSKSLLHSNGYTYLFWFLQRPGQSPQLLIYRMSNLASGVPDRFSGSGSGTAFTLRISRVEAEDVGVYYCMQHLEYPFTFGGGTKLEIK

SEQ ID NO: 19 - protein, 8 aa, synthetic construct
  REGION 1..8: note = Synthetic
IDPETGDT

SEQ ID NO: 20 - protein, 17 aa, synthetic construct
  REGION 1..17: note = Synthetic
WIDPETGDTEYASKFQD

SEQ ID NO: 21 - skipped

SEQ ID NO: 22 - protein, 117 aa, synthetic construct
  REGION 1..117: note = Synthetic
EVQLQQSGAELVRPGASVKLSCTASGFNIKDDYMYWVKQRPEQGLEWIGWIDPETGDTEYASKFQDKATVTADTSSNTAYLQLSSLTSEDTAVYYCTLWLRRGLDYWGQGTSVTVSS

SEQ ID NO: 23 - protein, 8 aa, synthetic construct
  REGION 1..8: note = Synthetic
IDPESGDT

SEQ ID NO: 24 - protein, 17 aa, synthetic construct
  REGION 1..17: note = Synthetic
WIDPESGDTEYASKFQD

SEQ ID NO: 25 - skipped

SEQ ID NO: 26 - protein, 117 aa, synthetic construct
  REGION 1..117: note = Synthetic
EVQLQQSGAELVRPGASVKLSCTASGFNIKDDYMYWVKQRPEQGLEWIGWIDPESGDTEYASKFQDKATVTADTSSNTAYLQLSSLTSEDTAVYYCTLWLRRGLDYWGQGTSVTVSS

SEQ ID NO: 27 - protein, 9 aa, synthetic construct
  REGION 1..9: note = Synthetic
GYSITSGYY

SEQ ID NO: 28 - protein, 7 aa, synthetic construct
  REGION 1..7: note = Synthetic
ITFDGAN

SEQ ID NO: 29 - protein, 12 aa, synthetic construct
  REGION 1..12: note = Synthetic
TRSSYDYDVLDY

SEQ ID NO: 30 - protein, 6 aa, synthetic construct
  REGION 1..6: note = Synthetic
QDISNF

SEQ ID NO: 31 - skipped

SEQ ID NO: 32 - protein, 9 aa, synthetic construct
  REGION 1..9: note = Synthetic
QQGHTLPYT

SEQ ID NO: 33 - protein, 6 aa, synthetic construct
  REGION 1..6: note = Synthetic
SGYYWN

SEQ ID NO: 34 - protein, 16 aa, synthetic construct
  REGION 1..16: note = Synthetic
YITFDGANNYNPSLKN

SEQ ID NO: 35 - protein, 10 aa, synthetic construct
  REGION 1..10: note = Synthetic
SSYDYDVLDY

SEQ ID NO: 36 - protein, 11 aa, synthetic construct
  REGION 1..11: note = Synthetic
RASQDISNFLN

SEQ ID NO: 37 - protein, 7 aa, synthetic construct
  REGION 1..7: note = Synthetic
YTSRLHS

SEQ ID NO: 38 - protein, 8 aa, synthetic construct
  REGION 1..8: note = Synthetic
GYSITSGY

SEQ ID NO: 39 - skipped

SEQ ID NO: 40 - protein, 8 aa, synthetic construct
  REGION 1..8: note = Synthetic
SYDYDVLD

SEQ ID NO: 41 - protein, 7 aa, synthetic construct
  REGION 1..7: note = Synthetic
SQDISNF

SEQ ID NO: 42 - protein, 6 aa, synthetic construct
  REGION 1..6: note = Synthetic
GHTLPY

SEQ ID NO: 43 - protein, 119 aa, synthetic construct
  REGION 1..119: note = Synthetic
DVQLQESGPGLVKPSQSLSLTCSVTGYSITSGYYWNWIRQFPGNKLEWMGYITFDGANNYNPSLKNRISITRDTSKNQFFLKLTSVTTEDTATYYCTRSSYDYDVLDYWGQGTTLTVSS

SEQ ID NO: 44 - protein, 107 aa, synthetic construct
  REGION 1..107: note = Synthetic
DIQMTQTTSSLSASLGDRVTISCRASQDISNFLNWYQQRPDGTVKLLIYYTSRLHSGVPSRFSGSGSGTDFSLTVSNLEQEDIATYFCQQGHTLPYTFGGGTKLEIK

SEQ ID NO: 45 - protein, 8 aa, synthetic construct
  REGION 1..8: note = Synthetic
GYSFTDYC

SEQ ID NO: 46 - protein, 8 aa, synthetic construct
  REGION 1..8: note = Synthetic
IYPGSGNT

SEQ ID NO: 47 - protein, 13 aa, synthetic construct
  REGION 1..13: note = Synthetic
AREDYYPYHGMDY

SEQ ID NO: 48 - protein, 10 aa, synthetic construct
  REGION 1..10: note = Synthetic
ESVDGYDNSF

SEQ ID NO: 49 - skipped

SEQ ID NO: 50 - protein, 9 aa, synthetic construct
  REGION 1..9: note = Synthetic
QQSSEDPWT

SEQ ID NO: 51 - protein, 5 aa, synthetic construct
  REGION 1..5: note = Synthetic
DYCIN

SEQ ID NO: 52 - protein, 17 aa, synthetic construct
  REGION 1..17: note = Synthetic
WIYPGSGNTRYSERFKG

SEQ ID NO: 53 - protein, 11 aa, synthetic construct
  REGION 1..11: note = Synthetic
EDYYPYHGMDY

SEQ ID NO: 54 - protein, 15 aa, synthetic construct
  REGION 1..15: note = Synthetic
RASESVDGYDNSFMH

SEQ ID NO: 55 - protein, 7 aa, synthetic construct
  REGION 1..7: note = Synthetic
RASNLES

SEQ ID NO: 56 - protein, 7 aa, synthetic construct
  REGION 1..7: note = Synthetic
GYSFTDY

SEQ ID NO: 57 - skipped

SEQ ID NO: 58 - protein, 9 aa, synthetic construct
  REGION 1..9: note = Synthetic
DYYPYHGMD

SEQ ID NO: 59 - protein, 11 aa, synthetic construct
  REGION 1..11: note = Synthetic
SESVDGYDNSF

SEQ ID NO: 60 - protein, 6 aa, synthetic construct
  REGION 1..6: note = Synthetic
SSEDPW

SEQ ID NO: 61 - protein, 120 aa, synthetic construct
  REGION 1..120: note = Synthetic
QIQLQQSGPELVRPGASVKISCKASGYSFTDYCINWVNQRPGQGLEWIGWIYPGSGNTRYSERFKGKATLTVDTSSNTAYMQLSSLTSEDSAVYFCAREDYYPYHGMDYWGQGTSVTVSS

SEQ ID NO: 62 - protein, 111 aa, synthetic construct
  REGION 1..111: note = Synthetic
DIVLTQSPTSLAVSLGQRATISCRASESVDGYDNSFMHWYQQKPGQPPKLLIFRASNLESGIPARFSGSGSRTDFTLTINPVEAADVATYYCQQSSEDPWTFGGGTKLEIK

SEQ ID NO: 63 - protein, 8 aa, synthetic construct
  REGION 1..8: note = Synthetic
GYSFTDYY

SEQ ID NO: 64 - protein, 5 aa, synthetic construct
  REGION 1..5: note = Synthetic
DYYIN

SEQ ID NO: 65 - protein, 120 aa, synthetic construct
  REGION 1..120: note = Synthetic
QIQLQQSGPELVRPGASVKISCKASGYSFTDYYINWVNQRPGQGLEWIGWIYPGSGNTRYSERFKGKATLTVDTSSNTAYMQLSSLTSEDSAVYFCAREDYYPYHGMDYWGQGTSVTVSS

SEQ ID NO: 66 - protein, 8 aa, synthetic construct
  REGION 1..8: note = Synthetic
GYSFTDYD

SEQ ID NO: 67 - protein, 5 aa, synthetic construct
  REGION 1..5: note = Synthetic
DYDIN

SEQ ID NO: 68 - protein, 120 aa, synthetic construct
  REGION 1..120: note = Synthetic
QIQLQQSGPELVRPGASVKISCKASGYSFTDYDINWVNQRPGQGLEWIGWIYPGSGNTRYSERFKGKATLTVDTSSNTAYMQLSSLTSEDSAVYFCAREDYYPYHGMDYWGQGTSVTVSS

SEQ ID NO: 69 - protein, 117 aa, synthetic construct
  REGION 1..117: note = Synthetic
EVQLVQSGSELKKPGASVKVSCTASGFNIKDDYMYWVRQPPGKGLEWIGWIDPETGDTEYASKFQDRVTVTADTSTNTAYMELSSLRSEDTAVYYCTLWLRRGLDYWGQGTLVTVSS

SEQ ID NO: 70 - protein, 112 aa, synthetic construct
  REGION 1..112: note = Synthetic
DIVMTQSPLSLPVTPGEPASISCRSSKSLLHSNGYTYLFWFQQRPGQSPRLLIYRMSNLASGVPDRFSGSGSGTDFTLKISRVEAEDVGVYYCMQHLEYPFTFGGGTKVEIK

SEQ ID NO: 71 - protein, 117 aa, synthetic construct
  REGION 1..117: note = Synthetic
EVQLVQSGSELKKPGASVKVSCTASGFNIKDDYMYWVRQPPGKGLEWIGWIDPESGDTEYASKFQDRVTVTADTSTNTAYMELSSLRSEDTAVYYCTLWLRRGLDYWGQGTLVTVSS

SEQ ID NO: 72 - protein, 117 aa, synthetic construct
  REGION 1..117: note = Synthetic
EVQLVQSGSELKKPGASVKVSCTASGFNIKDDYMYWVRQPPGKGLEWIGWIDPENGDTEYASKFQDRVTVTADTSTNTAYMELSSLRSEDTAVYYCTLWLRRGLDYWGQGTLVTVSS

SEQ ID NO: 73 - protein, 119 aa, synthetic construct
  REGION 1..119: note = Synthetic
QVQLQESGPGLVKPSQTLSLTCSVTGYSITSGYYWNWIRQPPGKGLEWMGYITFDGANNYNPSLKNRVSISRDTSKNQFSLKLSSVTAEDTATYYCTRSSYDYDVLDYWGQGTTVTVSS

SEQ ID NO: 74 - protein, 107 aa, synthetic construct
  REGION 1..107: note = Synthetic
DIQMTQSPSSLSASVGDRVTITCRASQDISNFLNWYQQKPGQPVKLLIYYTSRLHSGVPSRFSGSGSGTDFTLTISSLQPEDFATYFCQQGHTLPYTFGQGTKLEIK

SEQ ID NO: 75 - protein, 107 aa, synthetic construct
  REGION 1..107: note = Synthetic
DIQMTQSPSSLSASVGDRVTITCRASQDISNFLNWYQQKPGQPVKLLIYYTSRLHSGVPSRFSGSGSGTDFTLTISSLQPEDFATYYCQQGHTLPYTFGQGTKLEIK

SEQ ID NO: 76 - protein, 119 aa, synthetic construct
  REGION 1..119: note = Synthetic
QVQLQESGPGLVKPSQTLSLTCTVTGYSITSGYYWNWIRQPPGKGLEWIGYITFDGANNYNPSLKNRVSISRDTSKNQFSLKLSSVTAEDTATYYCTRSSYDYDVLDYWGQGTTVTVSS

SEQ ID NO: 77 - protein, 120 aa, synthetic construct
  REGION 1..120: note = Synthetic
QVQLVQSGAEVKKPGASVKVSCKASGYSFTDYYINWVRQAPGQGLEWMGWIYPGSGNTRYSERFKGRVTITRDTSASTAYMELSSLRSEDTAVYYCAREDYYPYHGMDYWGQGTLVTVSS

SEQ ID NO: 78 - protein, 111 aa, synthetic construct
  REGION 1..111: note = Synthetic
DIVLTQSPDSLAVSLGERATINCRASESVDGYDNSFMHWYQQKPGQPPKLLIFRASNLESGVPDRFSGSGSRTDFTLTISSLQAEDVAVYYCQQSSEDPWTFGQGTKLEIK

SEQ ID NO: 79 - protein, 120 aa, synthetic construct
  REGION 1..120: note = Synthetic
QVQLVQSGAEVKKPGASVKVSCKASGYSFTDYDINWVRQAPGQGLEWMGWIYPGSGNTRYSERFKGRVTITRDTSASTAYMELSSLRSEDTAVYYCAREDYYPYHGMDYWGQGTLVTVSS

SEQ ID NO: 80 - protein, 111 aa, synthetic construct
  REGION 1..111: note = Synthetic
DIVMTQSPDSLAVSLGERATINCRASESVDGYDNSFMHWYQQKPGQPPKLLIFRASNLESGVPDRFSGSGSGTDFTLTISSLQAEDVAVYYCQQSSEDPWTFGQGTKLEIK

SEQ ID NO: 81 - protein, 330 aa, Homo sapiens [sequence omitted]

SEQ ID NO: 82 - protein, 330 aa, synthetic construct
  REGION 1..330: note = Synthetic
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 107 aa, synthetic construct [sequence omitted]

SEQ ID NO: 84 - protein, 447 aa, synthetic construct
  REGION 1..447: note = Synthetic
EVQLVQSGSELKKPGASVKVSCTASGFNIKDDYMYWVRQPPGKGLEWIGWIDPETGDTEYASKFQDRVTVTADTSTNTAYMELSSLRSEDTAVYYCTLWLRRGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 219 aa, synthetic construct
  REGION 1..219: note = Synthetic
DIVMTQSPLSLPVTPGEPASISCRSSKSLLHSNGYTYLFWFQQRPGQSPRLLIYRMSNLASGVPDRFSGSGSGTDFTLKISRVEAEDVGVYYCMQHLEYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 86 - protein, 447 aa, synthetic construct
  REGION 1..447: note = Synthetic
EVQLVQSGSELKKPGASVKVSCTASGFNIKDDYMYWVRQPPGKGLEWIGWIDPESGDTEYASKFQDRVTVTADTSTNTAYMELSSLRSEDTAVYYCTLWLRRGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 447 aa, synthetic construct
  REGION 1..447: note = Synthetic
EVQLVQSGSELKKPGASVKVSCTASGFNIKDDYMYWVRQPPGKGLEWIGWIDPENGDTEYASKFQDRVTVTADTSTNTAYMELSSLRSEDTAVYYCTLWLRRGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 449 aa, synthetic construct
  REGION 1..449: note = Synthetic
QVQLQESGPGLVKPSQTLSLTCSVTGYSITSGYYWNWIRQPPGKGLEWMGYITFDGANNYNPSLKNRVSISRDTSKNQFSLKLSSVTAEDTATYYCTRSSYDYDVLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 214 aa, synthetic construct
  REGION 1..214: note = Synthetic
DIQMTQSPSSLSASVGDRVTITCRASQDISNFLNWYQQKPGQPVKLLIYYTSRLHSGVPSRFSGSGSGTDFTLTISSLQPEDFATYFCQQGHTLPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 90 - protein, 214 aa, synthetic construct
  REGION 1..214: note = Synthetic
DIQMTQSPSSLSASVGDRVTITCRASQDISNFLNWYQQKPGQPVKLLIYYTSRLHSGVPSRFSGSGSGTDFTLTISSLQPEDFATYYCQQGHTLPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 91 - protein, 449 aa, synthetic construct
  REGION 1..449: note = Synthetic
QVQLQESGPGLVKPSQTLSLTCTVTGYSITSGYYWNWIRQPPGKGLEWIGYITFDGANNYNPSLKNRVSISRDTSKNQFSLKLSSVTAEDTATYYCTRSSYDYDVLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - protein, 450 aa, synthetic construct
  REGION 1..450: note = Synthetic
QVQLVQSGAEVKKPGASVKVSCKASGYSFTDYYINWVRQAPGQGLEWMGWIYPGSGNTRYSERFKGRVTITRDTSASTAYMELSSLRSEDTAVYYCAREDYYPYHGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 218 aa, synthetic construct
  REGION 1..218: note = Synthetic
DIVLTQSPDSLAVSLGERATINCRASESVDGYDNSFMHWYQQKPGQPPKLLIFRASNLESGVPDRFSGSGSRTDFTLTISSLQAEDVAVYYCQQSSEDPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 94 - protein, 450 aa, synthetic construct
  REGION 1..450: note = Synthetic
QVQLVQSGAEVKKPGASVKVSCKASGYSFTDYDINWVRQAPGQGLEWMGWIYPGSGNTRYSERFKGRVTITRDTSASTAYMELSSLRSEDTAVYYCAREDYYPYHGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 218 aa, synthetic construct
  REGION 1..218: note = Synthetic
DIVMTQSPDSLAVSLGERATINCRASESVDGYDNSFMHWYQQKPGQPPKLLIFRASNLESGVPDRFSGSGSGTDFTLTISSLQAEDVAVYYCQQSSEDPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 96 - protein, 108 aa, synthetic construct
  REGION 1..108: note = Synthetic
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 97 - protein, 225 aa, synthetic construct
  REGION 1..225: note = Synthetic
EVQLVQSGSELKKPGASVKVSCTASGFNIKDDYMYWVRQPPGKGLEWIGWIDPETGDTEYASKFQDRVTVTADTSTNTAYMELSSLRSEDTAVYYCTLWLRRGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 98 - protein, 225 aa, synthetic construct
  REGION 1..225: note = Synthetic
EVQLVQSGSELKKPGASVKVSCTASGFNIKDDYMYWVRQPPGKGLEWIGWIDPESGDTEYASKFQDRVTVTADTSTNTAYMELSSLRSEDTAVYYCTLWLRRGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 99 - protein, 225 aa, synthetic construct
  REGION 1..225: note = Synthetic
EVQLVQSGSELKKPGASVKVSCTASGFNIKDDYMYWVRQPPGKGLEWIGWIDPENGDTEYASKFQDRVTVTADTSTNTAYMELSSLRSEDTAVYYCTLWLRRGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 100 - protein, 227 aa, synthetic construct
  REGION 1..227: note = Synthetic
QVQLQESGPGLVKPSQTLSLTCSVTGYSITSGYYWNWIRQPPGKGLEWMGYITFDGANNYNPSLKNRVSISRDTSKNQFSLKLSSVTAEDTATYYCTRSSYDYDVLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 101 - protein, 227 aa, synthetic construct
  REGION 1..227: note = Synthetic
QVQLQESGPGLVKPSQTLSLTCTVTGYSITSGYYWNWIRQPPGKGLEWIGYITFDGANNYNPSLKNRVSISRDTSKNQFSLKLSSVTAEDTATYYCTRSSYDYDVLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 102 - protein, 228 aa, synthetic construct
  REGION 1..228: note = Synthetic
QVQLVQSGAEVKKPGASVKVSCKASGYSFTDYYINWVRQAPGQGLEWMGWIYPGSGNTRYSERFKGRVTITRDTSASTAYMELSSLRSEDTAVYYCAREDYYPYHGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 103 - protein, 228 aa, synthetic construct
  REGION 1..228: note = Synthetic
QVQLVQSGAEVKKPGASVKVSCKASGYSFTDYDINWVRQAPGQGLEWMGWIYPGSGNTRYSERFKGRVTITRDTSASTAYMELSSLRSEDTAVYYCAREDYYPYHGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 104 - protein, 19 aa, synthetic construct
  REGION 1..19: note = Synthetic
MGWSCIILFLVATATGVHS

SEQ ID NO: 105 - protein, 760 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 106 - protein, 760 aa, Macaca mulatta
MMDQARSAFSNLFGGEPLSYTRFSLARQVDGDNSHVEMKLGVDEEENTDNNTKPNGTKPKRCGGNICYGTIAVIIFFLIGFMIGYLGYCKGVEPKTECERLAGTESPAREEPEEDFPAAPRLYWDDLKRKLSEKLDTTDFTSTIKLLNENLYVPREAGSQKDENLALYIENQFREFKLSKVWRDQHFVKIQVKDSAQNSVIIVDKNGGLVYLVENPGGYVAYSKAATVTGKLVHANFGTKKDFEDLDSPVNGSIVIVRAGKITFAEKVANAESLNAIGVLIYMDQTKFPIVKADLSFFGHAHLGTGDPYTPGFPSFNHTQFPPSQSSGLPNIPVQTISRAAAEKLFGNMEGDCPSDWKTDSTCKMVTSENKSVKLTVSNVLKETKILNIFGVIKGFVEPDHYVVVGAQRDAWGPGAAKSSVGTALLLKLAQMFSDMVLKDGFQPSRSIIFASWSAGDFGSVGATEWLEGYLSSLHLKAFTYINLDKAVLGTSNFKVSASPLLYTLIEKTMQDVKHPVTGRSLYQDSNWASKVEKLTLDNAAFPFLAYSGIPAVSFCFCEDTDYPYLGTTMDTYKELVERIPELNKVARAAAEVAGQFVIKLTHDTELNLDYERYNSQLLLFLRDLNQYRADVKEMGLSLQWLYSARGDFFRATSRLTTDFRNAEKRDKFVMKKLNDRVMRVEYYFLSPYVSPKESPFRHVFWGSGSHTLSALLESLKLRRQNNSAFNETLFRNQLALATWTIQGAANALSGDVWDIDNEF

SEQ ID NO: 107 - protein, 760 aa, Macaca fascicularis
MMDQARSAFSNLFGGEPLSYTRFSLARQVDGDNSHVEMKLGVDEEENTDNNTKANGTKPKRCGGNICYGTIAVIIFFLIGFMIGYLGYCKGVEPKTECERLAGTESPAREEPEEDFPAAPRLYWDDLKRKLSEKLDTTDFTSTIKLLNENLYVPREAGSQKDENLALYIENQFREFKLSKVWRDQHFVKIQVKDSAQNSVIIVDKNGGLVYLVENPGGYVAYSKAATVTGKLVHANFGTKKDFEDLDSPVNGSIVIVRAGKITFAEKVANAESLNAIGVLIYMDQTKFPIVKADLSFFGHAHLGTGDPYTPGFPSFNHTQFPPSQSSGLPNIPVQTISRAAAEKLFGNMEGDCPSDWKTDSTCKMVTSENKSVKLTVSNVLKETKILNIFGVIKGFVEPDHYVVVGAQRDAWGPGAAKSSVGTALLLKLAQMFSDMVLKDGFQPSRSIIFASWSAGDFGSVGATEWLEGYLSSLHLKAFTYINLDKAVLGTSNFKVSASPLLYTLIEKTMQDVKHPVTGRSLYQDSNWASKVEKLTLDNAAFPFLAYSGIPAVSFCFCEDTDYPYLGTTMDTYKELVERIPELNKVARAAAEVAGQFVIKLTHDTELNLDYERYNSQLLLFLRDLNQYRADVKEMGLSLQWLYSARGDFFRATSRLTTDFRNAEKRDKFVMKKLNDRVMRVEYYFLSPYVSPKESPFRHVFWGSGSHTLSALLESLKLRRQNNSAFNETLFRNQLALATWTIQGAANALSGDVWDIDNEF

SEQ ID NO: 108 - protein, 763 aa, Mus musculus
MMDQARSAFSNLFGGEPLSYTRFSLARQVDGDNSHVEMKLAADEEENADNNMKASVRKPKRFNGRLCFAAIALVIFFLIGFMSGYLGYCKRVEQKEECVKLAETEETDKSETMETEDVPTSSRLYWADLKTLLSEKLNSIEFADTIKQLSQNTYTPREAGSQKDESLAYYIENQFHEFKFSKVWRDEHYVKIQVKSSIGQNMVTIVQSNGNLDPVESPEGYVAFSKPTEVSGKLVHANFGTKKDFEELSYSVNGSLVIVRAGEITFAEKVANAQSFNAIGVLIYMDKNKFPVVEADLALFGHAHLGTGDPYTPGFPSFNHTQFPPSQSSGLPNIPVQTISRAAAEKLFGKMEGSCPARWNIDSSCKLELSQNQNVKLIVKNVLKERRILNIFGVIKGYEEPDRYVVVGAQRDALGAGVAAKSSVGTGLLLKLAQVFSDMISKDGFRPSRSIIFASWTAGDFGAVGATEWLEGYLSSLHLKAFTYINLDKVVLGTSNFKVSASPLLYTLMGKIMQDVKHPVDGKSLYRDSNWISKVEKLSFDNAAYPFLAYSGIPAVSFCFCEDADYPYLGTRLDTYEALTQKVPQLNQMVRTAAEVAGQLIIKLTHDVELNLDYEMYNSKLLSFMKDLNQFKTDIRDMGLSLQWLYSARGDYFRATSRLTTDFHNAEKTNRFVMREINDRIMKVEYHFLSPYVSPRESPFRHIFWGSGSHTLSALVENLKLRQKNITAFNETLFRNQLALATWTIQGVANALSGDIWNIDNEF

SEQ ID NO: 109 - protein, 197 aa, synthetic construct
  REGION 1..197: note = Synthetic
FVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKE

SEQ ID NO: 110 - protein, 5 aa, synthetic construct
  REGION 1..5: note = Synthetic
SYWMH

SEQ ID NO: 111 - protein, 17 aa, synthetic construct
  REGION 1..17: note = Synthetic
EINPTNGRTNYIEKFKS

SEQ ID NO: 112 - protein, 7 aa, synthetic construct
  REGION 1..7: note = Synthetic
GTRAYHY

SEQ ID NO: 113 - protein, 11 aa, synthetic construct
  REGION 1..11: note = Synthetic
RASDNLYSNLA

SEQ ID NO: 114 - protein, 7 aa, synthetic construct
  REGION 1..7: note = Synthetic
DATNLAD

SEQ ID NO: 115 - protein, 9 aa, synthetic construct
  REGION 1..9: note = Synthetic
QHFWGTPLT

SEQ ID NO: 116 - protein, 7 aa, synthetic construct
  REGION 1..7: note = Synthetic
GYTFTSY

SEQ ID NO: 117 - protein, 6 aa, synthetic construct
  REGION 1..6: note = Synthetic
NPTNGR

SEQ ID NO: 118 - protein, 6 aa, synthetic construct
  REGION 1..6: note = Synthetic
TSYWMH

SEQ ID NO: 119 - protein, 13 aa, synthetic construct
  REGION 1..13: note = Synthetic
WIGEINPTNGRTN

SEQ ID NO: 120 - protein, 6 aa, synthetic construct
  REGION 1..6: note = Synthetic
ARGTRA

SEQ ID NO: 121 - protein, 7 aa, synthetic construct
  REGION 1..7: note = Synthetic
YSNLAWY

SEQ ID NO: 122 - protein, 10 aa, synthetic construct
  REGION 1..10: note = Synthetic
LLVYDATNLA

SEQ ID NO: 123 - protein, 8 aa, synthetic construct
  REGION 1..8: note = Synthetic
QHFWGTPL

SEQ ID NO: 124 - protein, 116 aa, synthetic construct
  REGION 1..116: note = Synthetic
QVQLQQPGAELVKPGASVKLSCKASGYTFTSYWMHWVKQRPGQGLEWIGEINPTNGRTNYIEKFKSKATLTVDKSSSTAYMQLSSLTSEDSAVYYCARGTRAYHYWGQGTSVTVSS

SEQ ID NO: 125 - protein, 107 aa, synthetic construct
  REGION 1..107: note = Synthetic
DIQMTQSPASLSVSVGETVTITCRASDNLYSNLAWYQQKQGKSPQLLVYDATNLADGVPSRFSGSGSGTQYSLKINSLQSEDFGTYYCQHFWGTPLTFGAGTKLELK

SEQ ID NO: 126 - protein, 9 aa, synthetic construct
  REGION 1..9: note = Synthetic
QHFAGTPLT

SEQ ID NO: 127 - protein, 8 aa, synthetic construct
  REGION 1..8: note = Synthetic
QHFAGTPL

SEQ ID NO: 128 - protein, 116 aa, synthetic construct
  REGION 1..116: note = Synthetic
EVQLVQSGAEVKKPGASVKVSCKASGYTFTSYWMHWVRQAPGQRLEWIGEINPTNGRTNYIEKFKSRATLTVDKSASTAYMELSSLRSEDTAVYYCARGTRAYHYWGQGTMVTVSS

SEQ ID NO: 129 - protein, 107 aa, synthetic construct
  REGION 1..107: note = Synthetic
DIQMTQSPSSLSASVGDRVTITCRASDNLYSNLAWYQQKPGKSPKLLVYDATNLADGVPSRFSGSGSGTDYTLTISSLQPEDFATYYCQHFWGTPLTFGQGTKVEIK

SEQ ID NO: 130 - protein, 330 aa, Homo sapiens [sequence omitted]

SEQ ID NO: 131 - RNA, 18 nt, synthetic construct
  misc_feature 1..18: note = Synthetic
  source 1..18: mol_type = other RNA
gagtcttctaggagcctt

SEQ ID NO: 132 - protein, 446 aa, synthetic construct
  REGION 1..446: note = Synthetic
QVQLQQPGAELVKPGASVKLSCKASGYTFTSYWMHWVKQRPGQGLEWIGEINPTNGRTNYIEKFKSKATLTVDKSSSTAYMQLSSLTSEDSAVYYCARGTRAYHYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 133 - protein, 214 aa, synthetic construct
  REGION 1..214: note = Synthetic
DIQMTQSPASLSVSVGETVTITCRASDNLYSNLAWYQQKQGKSPQLLVYDATNLADGVPSRFSGSGSGTQYSLKINSLQSEDFGTYYCQHFWGTPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 134 - protein, 446 aa, synthetic construct
  REGION 1..446: note = Synthetic
EVQLVQSGAEVKKPGASVKVSCKASGYTFTSYWMHWVRQAPGQRLEWIGEINPTNGRTNYIEKFKSRATLTVDKSASTAYMELSSLRSEDTAVYYCARGTRAYHYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 135 - protein, 214 aa, synthetic construct
  REGION 1..214: note = Synthetic
DIQMTQSPSSLSASVGDRVTITCRASDNLYSNLAWYQQKPGKSPKLLVYDATNLADGVPSRFSGSGSGTDYTLTISSLQPEDFATYYCQHFWGTPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 136 - protein, 226 aa, synthetic construct
  REGION 1..226: note = Synthetic
QVQLQQPGAELVKPGASVKLSCKASGYTFTSYWMHWVKQRPGQGLEWIGEINPTNGRTNYIEKFKSKATLTVDKSSSTAYMQLSSLTSEDSAVYYCARGTRAYHYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCP

SEQ ID NO: 137 - protein, 226 aa, synthetic construct
  REGION 1..226: note = Synthetic
EVQLVQSGAEVKKPGASVKVSCKASGYTFTSYWMHWVRQAPGQRLEWIGEINPTNGRTNYIEKFKSRATLTVDKSASTAYMELSSLRSEDTAVYYCARGTRAYHYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCP

SEQ ID NO: 138 - protein, 7 aa, synthetic construct
  REGION 1..7: note = Synthetic
ASSLNIA

SEQ ID NO: 139 - protein, 12 aa, synthetic construct
  REGION 1..12: note = Synthetic
SKTFNTHPQSTP

SEQ ID NO: 140 - protein, 12 aa, synthetic construct
  REGION 1..12: note = Synthetic
TARGEHKEEELI

SEQ ID NO: 141 - protein, 9 aa, synthetic construct
  REGION 1..9: note = Synthetic
CQAQGQLVC

SEQ ID NO: 142 - protein, 9 aa, synthetic construct
  REGION 1..9: note = Synthetic
CSERSMNFC

SEQ ID NO: 143 - protein, 9 aa, synthetic construct
  REGION 1..9: note = Synthetic
CPKTRRVPC

SEQ ID NO: 144 - protein, 20 aa, synthetic construct
  REGION 1..20: note = Synthetic
WLSEAGPVVTVRALRGTGSW

SEQ ID NO: 145 - protein, 9 aa, synthetic construct
  REGION 1..9: note = Synthetic
CMQHSMRVC

SEQ ID NO: 146 - protein, 7 aa, synthetic construct
  REGION 1..7: note = Synthetic
DDTRHWG

SEQ ID NO: 147 - RNA, 21 nt, synthetic construct
  misc_feature 1..21: note = Synthetic
  source 1..21: mol_type = other RNA
tcctatgactgtagattttat

SEQ ID NO: 148 - RNA, 23 nt, synthetic construct
  misc_feature 1..23: note = Synthetic
  source 1..23: mol_type = other RNA
ataaaatctacagtcataggaat

SEQ ID NO: 149 - RNA, 21 nt, synthetic construct
  misc_feature 1..21: note = Synthetic
  source 1..21: mol_type = other RNA
tgtaataaccatatctacctt

SEQ ID NO: 150 - RNA, 23 nt, synthetic construct
  misc_feature 1..23: note = Synthetic
  source 1..23: mol_type = other RNA
aaggtagatatggttattacaaa

SEQ ID NO: 151 - RNA, 19 nt, synthetic construct
  misc_feature 1..19: note = Synthetic
  source 1..19: mol_type = other RNA
cttcctggatggcttcaat

SEQ ID NO: 152 - RNA, 19 nt, synthetic construct
  misc_feature 1..19: note = Synthetic
  source 1..19: mol_type = other RNA
gtacattaagatggacttc

SEQ ID NO: 153 - RNA, 30 nt, synthetic construct
  misc_feature 1..30: note = Synthetic
  source 1..30: mol_type = other RNA
tatctggataggtggtatcaagatctgtaa

SEQ ID NO: 154 - RNA, 25 nt, synthetic construct
  misc_feature 1..25: note = Synthetic
  source 1..25: mol_type = other RNA
atgtaactgaaaatgttcttcttta

SEQ ID NO: 155 - RNA, 30 nt, synthetic construct
  misc_feature 1..30: note = Synthetic
  source 1..30: mol_type = other RNA
tggataggtggtatcaacatctgtaagcac

SEQ ID NO: 156 - RNA, 22 nt, synthetic construct
  misc_feature 1..22: note = Synthetic
  source 1..22: mol_type = other RNA
gataggtggtatcaacatctgt

SEQ ID NO: 157 - RNA, 30 nt, synthetic construct
  misc_feature 1..30: note = Synthetic
  source 1..30: mol_type = other RNA
tatctggataggtggtatcaacatctgtaa

SEQ ID NO: 158 - RNA, 25 nt, synthetic construct
  misc_feature 1..25: note = Synthetic
  source 1..25: mol_type = other RNA
aaacttggaagagtgatgtgatgta

SEQ ID NO: 159 - RNA, 27 nt, synthetic construct
  misc_feature 1..27: note = Synthetic
  source 1..27: mol_type = other RNA
gctcacttgttgaggcaaaacttggaa

SEQ ID NO: 160 - RNA, 25 nt, synthetic construct
  misc_feature 1..25: note = Synthetic
  source 1..25: mol_type = other RNA
gccttggcaacatttccacttcctg

SEQ ID NO: 161 - RNA, 25 nt, synthetic construct
  misc_feature 1..25: note = Synthetic
  source 1..25: mol_type = other RNA
tacacactttacctgttgagaatag

SEQ ID NO: 162 - RNA, 24 nt, synthetic construct
  misc_feature 1..24: note = Synthetic
  source 1..24: mol_type = other RNA
gataggtggtatcaacatctgtaa

SEQ ID NO: 163 - RNA, 21 nt, synthetic construct
  misc_feature 1..21: note = Synthetic
  source 1..21: mol_type = other RNA
gataggtggtatcaacatctg

SEQ ID NO: 164 - RNA, 25 nt, synthetic construct
  misc_feature 1..25: note = Synthetic
  source 1..25: mol_type = other RNA
gataggtggtatcaacatctgtaag

SEQ ID NO: 165 - RNA, 20 nt, synthetic construct
  misc_feature 1..20: note = Synthetic
  source 1..20: mol_type = other RNA
ggtggtatcaacatctgtaa

SEQ ID NO: 166 - RNA, 20 nt, synthetic construct
  misc_feature 1..20: note = Synthetic
  source 1..20: mol_type = other RNA
gtatcaacatctgtaagcac

SEQ ID NO: 167 - RNA, 30 nt, synthetic construct
  misc_feature 1..30: note = Synthetic
  misc_feature 27: note = n is a, c, g, or u
  source 1..30: mol_type = other RNA
cggctaatttcagagggcgctttcttngac

SEQ ID NO: 168 - RNA, 26 nt, synthetic construct
  misc_feature 1..26: note = Synthetic
  source 1..26: mol_type = other RNA
acagtggtgctgagatagtataggcc

SEQ ID NO: 169 - RNA, 22 nt, synthetic construct
  misc_feature 1..22: note = Synthetic
  source 1..22: mol_type = other RNA
taggccactttgttgctcttgc

SEQ ID NO: 170 - RNA, 19 nt, synthetic construct
  misc_feature 1..19: note = Synthetic
  source 1..19: mol_type = other RNA
ttcagagggcgctttcttc

SEQ ID NO: 171 - RNA, 25 nt, synthetic construct
  misc_feature 1..25: note = Synthetic
  source 1..25: mol_type = other RNA
ggccaaacctcggcttacctgaaat

SEQ ID NO: 172 - RNA, 20 nt, synthetic construct
  misc_feature 1..20: note = Synthetic
  source 1..20: mol_type = other RNA
ggccaaacctcggcttacct

SEQ ID NO: 173 - RNA, 30 nt, synthetic construct
  misc_feature 1..30: note = Synthetic
  source 1..30: mol_type = other RNA
tcttcaggtgcaccttctgtttctcaatct

SEQ ID NO: 174 - RNA, 30 nt, synthetic construct
  misc_feature 1..30: note = Synthetic
  source 1..30: mol_type = other RNA
tctgtgatactcttcaggtgcaccttctgt

SEQ ID NO: 175 - RNA, 21 nt, synthetic construct
  misc_feature 1..21: note = Synthetic
  source 1..21: mol_type = other RNA
tcttctgctcgggaggtgaca

SEQ ID NO: 176 - RNA, 20 nt, synthetic construct
  misc_feature 1..20: note = Synthetic
  source 1..20: mol_type = other RNA
ccagttactattcagaagac

SEQ ID NO: 177 - RNA, 20 nt, synthetic construct
  misc_feature 1..20: note = Synthetic
  source 1..20: mol_type = other RNA
tcttcaggtgcaccttctgt

SEQ ID NO: 178 - RNA, 18 nt, synthetic construct
  misc_feature 1..18: note = Synthetic
  source 1..18: mol_type = other RNA
tgctgctgtcttcttgct

SEQ ID NO: 179 - RNA, 19 nt, synthetic construct
  misc_feature 1..19: note = Synthetic
  source 1..19: mol_type = other RNA
ttgttaactttttcccatt

SEQ ID NO: 180 - RNA, 20 nt, synthetic construct
  misc_feature 1..20: note = Synthetic
  source 1..20: mol_type = other RNA
tgttaactttttcccattgg

SEQ ID NO: 181 - RNA, 20 nt, synthetic construct
  misc_feature 1..20: note = Synthetic
  source 1..20: mol_type = other RNA
cattttgttaactttttccc

SEQ ID NO: 182 - RNA, 19 nt, synthetic construct
  misc_feature 1..19: note = Synthetic
  source 1..19: mol_type = other RNA
ctgtagcttcaccctttcc

SEQ ID NO: 183 - RNA, 26 nt, synthetic construct
  misc_feature 1..26: note = Synthetic
  source 1..26: mol_type = other RNA
gagagcttcctgtagcttcacccttt

SEQ ID NO: 184 - RNA, 28 nt, synthetic construct
  misc_feature 1..28: note = Synthetic
  source 1..28: mol_type = other RNA
tcctgtagcttcaccctttccacaggcg

SEQ ID NO: 185 - RNA, 20 nt, synthetic construct
  misc_feature 1..20: note = Synthetic
  source 1..20: mol_type = other RNA
tgtgttacctacccttgtcg

SEQ ID NO: 186 - RNA, 27 nt, synthetic construct
  misc_feature 1..27: note = Synthetic
  source 1..27: mol_type = other RNA
tagactatcttttatattctgtaatat

SEQ ID NO: 187 - RNA, 29 nt, synthetic construct
  misc_feature 1..29: note = Synthetic
  source 1..29: mol_type = other RNA
gagagcttcctgtagcttcaccctttcca

SEQ ID NO: 188 - RNA, 31 nt, synthetic construct
  misc_feature 1..31: note = Synthetic
  source 1..31: mol_type = other RNA
ttcctgtagcttcaccctttccacaggcgtt

SEQ ID NO: 189 - RNA, 23 nt, synthetic construct
  misc_feature 1..23: note = Synthetic
  source 1..23: mol_type = other RNA
agcttcctgtagcttcacccttt

SEQ ID NO: 190 - RNA, 29 nt, synthetic construct
  misc_feature 1..29: note = Synthetic
  source 1..29: mol_type = other RNA
ggagagagcttcctgtagcttcacccttt

SEQ ID NO: 191 - RNA, 23 nt, synthetic construct
  misc_feature 1..23: note = Synthetic
  source 1..23: mol_type = other RNA
gagagcttcctgtagcttcaccc

SEQ ID NO: 192 - RNA, 25 nt, synthetic construct
  misc_feature 1..25: note = Synthetic
  source 1..25: mol_type = other RNA
tatgtgttacctacccttgtcggtc

SEQ ID NO: 193 - RNA, 20 nt, synthetic construct
  misc_feature 1..20: note = Synthetic
  source 1..20: mol_type = other RNA
ggagagagcttcctgtagct

SEQ ID NO: 194 - RNA, 23 nt, synthetic construct
  misc_feature 1..23: note = Synthetic
  source 1..23: mol_type = other RNA
tcaccctttccacaggcgttgca

SEQ ID NO: 195 - RNA, 28 nt, synthetic construct
  misc_feature 1..28: note = Synthetic
  source 1..28: mol_type = other RNA
gctgggagagagcttcctgtagcttcac

SEQ ID NO: 196 - RNA, 28 nt, synthetic construct
  misc_feature 1..28: note = Synthetic
  source 1..28: mol_type = other RNA
tgttacctacccttgtcggtccttgtac

SEQ ID NO: 197 - RNA, 28 nt, synthetic construct
  misc_feature 1..28: note = Synthetic
  source 1..28: mol_type = other RNA
ctgctgtcttcttgctatgaataatgtc

SEQ ID NO: 198 - RNA, 28 nt, synthetic construct
  misc_feature 1..28: note = Synthetic
  source 1..28: mol_type = other RNA
ggcgttgcactttgcaatgctgctgtct

SEQ ID NO: 199 - RNA, 28 nt, synthetic construct
  misc_feature 1..28: note = Synthetic
  source 1..28: mol_type = other RNA
ttggaaatcaagctgggagagagcttcc

SEQ ID NO: 200 - RNA, 28 nt, synthetic construct
  misc_feature 1..28: note = Synthetic
  source 1..28: mol_type = other RNA
ctacccttgtcggtccttgtacattttg

SEQ ID NO: 201 - RNA, 28 nt, synthetic construct
  misc_feature 1..28: note = Synthetic
  source 1..28: mol_type = other RNA
gtcaatccgacctgagctttgttgtaga

SEQ ID NO: 202 - RNA, 27 nt, synthetic construct
  misc_feature 1..27: note = Synthetic
  source 1..27: mol_type = other RNA
cttgctatgaataatgtcaatccgacc

SEQ ID NO: 203 - RNA, 28 nt, synthetic construct
  misc_feature 1..28: note = Synthetic
  source 1..28: mol_type = other RNA
tatatgtgttacctacccttgtcggtcc

SEQ ID NO: 204 - RNA, 29 nt, synthetic construct
  misc_feature 1..29: note = Synthetic
  source 1..29: mol_type = other RNA
aatcagctgggagagagcttcctgtagct

SEQ ID NO: 205 - RNA, 26 nt, synthetic construct
  misc_feature 1..26: note = Synthetic
  source 1..26: mol_type = other RNA
tcgttcttctgtcgtcgtaacgtttc

SEQ ID NO: 206 - RNA, 20 nt, synthetic construct
  misc_feature 1..20: note = Synthetic
  source 1..20: mol_type = other RNA
tttgtgtctttctgagaaac

SEQ ID NO: 207 - RNA, 20 nt, synthetic construct
  misc_feature 1..20: note = Synthetic
  source 1..20: mol_type = other RNA
aaagacttaccttaagatac

SEQ ID NO: 208 - RNA, 20 nt, synthetic construct
  misc_feature 1..20: note = Synthetic
  source 1..20: mol_type = other RNA
atctgtcaaatcgcctgcag

SEQ ID NO: 209 - RNA, 19 nt, synthetic construct
  misc_feature 1..19: note = Synthetic
  source 1..19: mol_type = other RNA
cgccgccatttctcaacag

SEQ ID NO: 210 - RNA, 20 nt, synthetic construct
  misc_feature 1..20: note = Synthetic
  source 1..20: mol_type = other RNA
tttgtatttagcatgttccc

SEQ ID NO: 211 - RNA, 17 nt, synthetic construct
  misc_feature 1..17: note = Synthetic
  source 1..17: mol_type = other RNA
ccgccatttctcaacag

SEQ ID NO: 212 - RNA, 21 nt, synthetic construct
  misc_feature 1..21: note = Synthetic
  source 1..21: mol_type = other RNA
ttctcaggaatttgtgtcttt

SEQ ID NO: 213 - RNA, 11 nt, synthetic construct
  misc_feature 1..11: note = Synthetic
  source 1..11: mol_type = other RNA
gacaactcttt

SEQ ID NO: 214 - RNA, 20 nt, synthetic construct
  misc_feature 1..20: note = Synthetic
  source 1..20: mol_type = other RNA
tcagcttctgttagccactg

SEQ ID NO: 215 - RNA, 24 nt, synthetic construct
  misc_feature 1..24: note = Synthetic
  source 1..24: mol_type = other RNA
tgttcagcttctgttagccactga

SEQ ID NO: 216 - RNA, 27 nt, synthetic construct
  misc_feature 1..27: note = Synthetic
  source 1..27: mol_type = other RNA
ctgttcagcttctgttagccactgatt

SEQ ID NO: 217 - RNA, 30 nt, synthetic construct
  misc_feature 1..30: note = Synthetic
  source 1..30: mol_type = other RNA
ttctcaacagatctgtcaaatcgcctgcag

SEQ ID NO: 218 - RNA, 25 nt, synthetic construct
  misc_feature 1..25: note = Synthetic
  source 1..25: mol_type = other RNA
gccactgattaaatatctttatatc

SEQ ID NO: 219 - RNA, 30 nt, synthetic construct
  misc_feature 1..30: note = Synthetic
  source 1..30: mol_type = other RNA
tctgttagccactgattaaatatctttata

SEQ ID NO: 220 - RNA, 31 nt, synthetic construct
  misc_feature 1..31: note = Synthetic
  source 1..31: mol_type = other RNA
gagaaactgttcagcttctgttagccactga

SEQ ID NO: 221 - RNA, 31 nt, synthetic construct
  misc_feature 1..31: note = Synthetic
  source 1..31: mol_type = other RNA
tctttctgagaaactgttcagcttctgttag

SEQ ID NO: 222 - RNA, 26 nt, synthetic construct
  misc_feature 1..26: note = Synthetic
  source 1..26: mol_type = other RNA
cagatctgtcaaatcgcctgcaggta

SEQ ID NO: 223 - RNA, 26 nt, synthetic construct
  misc_feature 1..26: note = Synthetic
  source 1..26: mol_type = other RNA
caacagatctgtcaaatcgcctgcag

SEQ ID NO: 224 - RNA, 33 nt, synthetic construct
  misc_feature 1..33: note = Synthetic
  source 1..33: mol_type = other RNA
aaactgttcagcttctgttagccactgattaaa

SEQ ID NO: 225 - RNA, 31 nt, synthetic construct
  misc_feature 1..31: note = Synthetic
  source 1..31: mol_type = other RNA
gaaactgttcagcttctgttagccactgatt

SEQ ID NO: 226 - RNA, 28 nt, synthetic construct
  misc_feature 1..28: note = Synthetic
  source 1..28: mol_type = other RNA
aaactgttcagcttctgttagccactga

SEQ ID NO: 227 - RNA, 28 nt, synthetic construct
  misc_feature 1..28: note = Synthetic
  source 1..28: mol_type = other RNA
tgagaaactgttcagcttctgttagcca

SEQ ID NO: 228 - RNA, 32 nt, synthetic construct
  misc_feature 1..32: note = Synthetic
  source 1..32: mol_type = other RNA
ttctgagaaactgttcagcttctgttagccac

SEQ ID NO: 229 - RNA, 26 nt, synthetic construct
  misc_feature 1..26: note = Synthetic
  source 1..26: mol_type = other RNA
ttctgagaaactgttcagcttctgtt

SEQ ID NO: 230 - RNA, 25 nt, synthetic construct
  misc_feature 1..25: note = Synthetic
  source 1..25: mol_type = other RNA
gatctgtcaaatcgcctgcaggtaa

SEQ ID NO: 231 - RNA, 25 nt, synthetic construct
  misc_feature 1..25: note = Synthetic
  source 1..25: mol_type = other RNA
ataatgaaaacgccgccatttctca

SEQ ID NO: 232 - RNA, 25 nt, synthetic construct
  misc_feature 1..25: note = Synthetic
  source 1..25: mol_type = other RNA
aaactgttcagcttctgttagccac

SEQ ID NO: 233 - RNA, 25 nt, synthetic construct
  misc_feature 1..25: note = Synthetic
  source 1..25: mol_type = other RNA
ttgtgtctttctgagaaactgttca

SEQ ID NO: 234 - RNA, 25 nt, synthetic construct
  misc_feature 1..25: note = Synthetic
  source 1..25: mol_type = other RNA
ccaattctcaggaatttgtgtcttt

SEQ ID NO: 235 - RNA, 25 nt, synthetic construct
  misc_feature 1..25: note = Synthetic
  source 1..25: mol_type = other RNA
atcgcctgcaggtaaaagcatatgg

SEQ ID NO: 236 - RNA, 30 nt, synthetic construct
  misc_feature 1..30: note = Synthetic
  source 1..30: mol_type = other RNA
tgaaaacgccgccatttctcaacagatctg

SEQ ID NO: 237 - RNA, 30 nt, synthetic construct
  misc_feature 1..30: note = Synthetic
  source 1..30: mol_type = other RNA
cataatgaaaacgccgccatttctcaacag

SEQ ID NO: 238 - RNA, 30 nt, synthetic construct
  misc_feature 1..30: note = Synthetic
  source 1..30: mol_type = other RNA
tgttcagcttctgttagccactgattaaat

SEQ ID NO: 239 - RNA, 24 nt, synthetic construct
  misc_feature 1..24: note = Synthetic
  source 1..24: mol_type = other RNA
cagatctgtcaaatcgcctgcagg

SEQ ID NO: 240 - RNA, 27 nt, synthetic construct
  misc_feature 1..27: note = Synthetic
  source 1..27: mol_type = other RNA
caacagatctgtcaaatcgcctgcagg

SEQ ID NO: 241 - RNA, 29 nt, synthetic construct
  misc_feature 1..29: note = Synthetic
  source 1..29: mol_type = other RNA
ctcaacagatctgtcaaatcgcctgcagg

SEQ ID NO: 242 - RNA, 23 nt, synthetic construct
  misc_feature 1..23: note = Synthetic
  source 1..23: mol_type = other RNA
gatctgtcaaatcgcctgcaggt

SEQ ID NO: 243 - RNA, 22 nt, synthetic construct
  misc_feature 1..22: note = Synthetic
  source 1..22: mol_type = other RNA
gatctgtcaaatcgcctgcagg

SEQ ID NO: 244 - RNA, 21 nt, synthetic construct
  misc_feature 1..21: note = Synthetic
  source 1..21: mol_type = other RNA
gatctgtcaaatcgcctgcag

SEQ ID NO: 245 - RNA, 25 nt, synthetic construct
  misc_feature 1..25: note = Synthetic
  source 1..25: mol_type = other RNA
cagatctgtcaaatcgcctgcaggt

SEQ ID NO: 246 - RNA, 23 nt, synthetic construct
  misc_feature 1..23: note = Synthetic
  source 1..23: mol_type = other RNA
cagatctgtcaaatcgcctgcag

SEQ ID NO: 247 - RNA, 25 nt, synthetic construct
  misc_feature 1..25: note = Synthetic
  source 1..25: mol_type = other RNA
gtgtctttctgagaaactgttcagc

SEQ ID NO: 248 - RNA, 28 nt, synthetic construct
  misc_feature 1..28: note = Synthetic
  source 1..28: mol_type = other RNA
gagaaactgttcagcttctgttagccac

SEQ ID NO: 249 - RNA, 28 nt, synthetic construct
  misc_feature 1..28: note = Synthetic
  source 1..28: mol_type = other RNA
gaaactgttcagcttctgttagccactg

SEQ ID NO: 250 - RNA, 24 nt, synthetic construct
  misc_feature 1..24: note = Synthetic
  source 1..24: mol_type = other RNA
ctgttcagcttctgttagccactg

SEQ ID NO: 251 - RNA, 27 nt, synthetic construct
  misc_feature 1..27: note = Synthetic
  source 1..27: mol_type = other RNA
atctgtcaaatcgcctgcaggtaaaag

SEQ ID NO: 252 - RNA, 29 nt, synthetic construct
  misc_feature 1..29: note = Synthetic
  source 1..29: mol_type = other RNA
gatctgtcaaatcgcctgcaggtaaaagc

SEQ ID NO: 253 - RNA, 16 nt, synthetic construct
  misc_feature 1..16: note = Synthetic
  source 1..16: mol_type = other RNA
caccgattgtcttcga

SEQ ID NO: 254 - RNA, 17 nt, synthetic construct
  misc_feature 1..17: note = Synthetic
  source 1..17: mol_type = other RNA
cccttgtacgatttatg

SEQ ID NO: 255 - RNA, 18 nt, synthetic construct
  misc_feature 1..18: note = Synthetic
  source 1..18: mol_type = other RNA
tctgtgtttaaggactct

SEQ ID NO: 256 - RNA, 19 nt, synthetic construct
  misc_feature 1..19: note = Synthetic
  source 1..19: mol_type = other RNA
gctgaattatttcttcccc

SEQ ID NO: 257 - RNA, 19 nt, synthetic construct
  misc_feature 1..19: note = Synthetic
  source 1..19: mol_type = other RNA
tttttctgtctgacagctg

SEQ ID NO: 258 - RNA, 18 nt, synthetic construct
  misc_feature 1..18: note = Synthetic
  source 1..18: mol_type = other RNA
tctgtttttgaggattgc

SEQ ID NO: 259 - RNA, 17 nt, synthetic construct
  misc_feature 1..17: note = Synthetic
  source 1..17: mol_type = other RNA
ccaccgcagattcaggc

SEQ ID NO: 260 - RNA, 17 nt, synthetic construct
  misc_feature 1..17: note = Synthetic
  source 1..17: mol_type = other RNA
gcccaatgccatcctgg

SEQ ID NO: 261 - RNA, 17 nt, synthetic construct
  misc_feature 1..17: note = Synthetic
  source 1..17: mol_type = other RNA
tttgcagacctcctgcc

SEQ ID NO: 262 - RNA, 17 nt, synthetic construct
  misc_feature 1..17: note = Synthetic
  source 1..17: mol_type = other RNA
cagtttgccgctgccca

SEQ ID NO: 263 - RNA, 20 nt, synthetic construct
  misc_feature 1..20: note = Synthetic
  source 1..20: mol_type = other RNA
gttgcattcaatgttctgac

SEQ ID NO: 264 - RNA, 21 nt, synthetic construct
  misc_feature 1..21: note = Synthetic
  source 1..21: mol_type = other RNA
atttttcctgtagaatactgg

SEQ ID NO: 265 - RNA, 34 nt, synthetic construct
  misc_feature 1..34: note = Synthetic
  source 1..34: mol_type = other RNA
gctgcccaatgcgatcctggagttcctgtaagat

SEQ ID NO: 266 - RNA, 28 nt, synthetic construct
  misc_feature 1..28: note = Synthetic
  source 1..28: mol_type = other RNA
gctgcccaatgccatcctggagttcctg

SEQ ID NO: 267 - RNA, 31 nt, synthetic construct
  misc_feature 1..31: note = Synthetic
  source 1..31: mol_type = other RNA
gctgcccaatgccatcctggagttcctgtaa

SEQ ID NO: 268 - RNA, 31 nt, synthetic construct
  misc_feature 1..31: note = Synthetic
  source 1..31: mol_type = other RNA
caatgccatcctggagttcctgtaagatacc

SEQ ID NO: 269 - RNA, 32 nt, synthetic construct
  misc_feature 1..32: note = Synthetic
  source 1..32: mol_type = other RNA
gctgcccaatgccatcctggagttcctgtaag

SEQ ID NO: 270 - RNA, 30 nt, synthetic construct
  misc_feature 1..30: note = Synthetic
  source 1..30: mol_type = other RNA
ccaatgccatcctggagttcctgtaagata

SEQ ID NO: 271 - RNA, 39 nt, synthetic construct
  misc_feature 1..39: note = Synthetic
  source 1..39: mol_type = other RNA
ttgccgctgcccaatgccatcctggagttcctgtaagat

SEQ ID NO: 272 - RNA, 34 nt, synthetic construct
  misc_feature 1..34: note = Synthetic
  source 1..34: mol_type = other RNA
gctgcccaatgccatcctggagttcctgtaagat

SEQ ID NO: 273 - RNA, 27 nt, synthetic construct
  misc_feature 1..27: note = Synthetic
  source 1..27: mol_type = other RNA
caatgccatcctggagttcctgtaaga

SEQ ID NO: 274 - RNA, 26 nt, synthetic construct
  misc_feature 1..26: note = Synthetic
  source 1..26: mol_type = other RNA
cagtttgccgctgcccaatgccatcc

SEQ ID NO: 275 - RNA, 24 nt, synthetic construct
  misc_feature 1..24: note = Synthetic
  source 1..24: mol_type = other RNA
cttccccagttgcattcaatgttc

SEQ ID NO: 276 - RNA, 23 nt, synthetic construct
  misc_feature 1..23: note = Synthetic
  source 1..23: mol_type = other RNA
ctggcatctgtttttgaggattg

SEQ ID NO: 277 - RNA, 20 nt, synthetic construct
  misc_feature 1..20: note = Synthetic
  source 1..20: mol_type = other RNA
ttagatctgtcgccctacct

SEQ ID NO: 278 - RNA, 39 nt, synthetic construct
  misc_feature 1..39: note = Synthetic
  source 1..39: mol_type = other RNA
gctgcccaatgccatcctggagttcctgtaagataccaa

SEQ ID NO: 279 - RNA, 34 nt, synthetic construct
  misc_feature 1..34: note = Synthetic
  source 1..34: mol_type = other RNA
gcccaatgccatcctggagttcctgtaagatacc

SEQ ID NO: 280 - RNA, 25 nt, synthetic construct
  misc_feature 1..25: note = Synthetic
  source 1..25: mol_type = other RNA
catcctggagttcctgtaagatacc

SEQ ID NO: 281 - RNA, 28 nt, synthetic construct
  misc_feature 1..28: note = Synthetic
  source 1..28: mol_type = other RNA
tgccatcctggagttcctgtaagatacc

SEQ ID NO: 282 - RNA, 25 nt, synthetic construct
  misc_feature 1..25: note = Synthetic
  source 1..25: mol_type = other RNA
tgccatcctggagttcctgtaagat

SEQ ID NO: 283 - RNA, 28 nt, synthetic construct
  misc_feature 1..28: note = Synthetic
  source 1..28: mol_type = other RNA
caatgccatcctggagttcctgtaagat

SEQ ID NO: 284 - RNA, 31 nt, synthetic construct
  misc_feature 1..31: note = Synthetic
  source 1..31: mol_type = other RNA
gcccaatgccatcctggagttcctgtaagat

SEQ ID NO: 285 - RNA, 28 nt, synthetic construct
  misc_feature 1..28: note = Synthetic
  source 1..28: mol_type = other RNA
gcccaatgccatcctggagttcctgtaa

SEQ ID NO: 286 - RNA, 34 nt, synthetic construct
  misc_feature 1..34: note = Synthetic
  source 1..34: mol_type = other RNA
gccgctgcccaatgacatcctggagttcctgtaa

SEQ ID NO: 287 - RNA, 25 nt, synthetic construct
  misc_feature 1..25: note = Synthetic
  source 1..25: mol_type = other RNA
gccatcctggagttcctgtaagata

SEQ ID NO: 288 - RNA, 25 nt, synthetic construct
  misc_feature 1..25: note = Synthetic
  source 1..25: mol_type = other RNA
ccaatgccatcctggagttcctgta

SEQ ID NO: 289 - RNA, 25 nt, synthetic construct
  misc_feature 1..25: note = Synthetic
  source 1..25: mol_type = other RNA
ctgacaacagtttgccgctgcccaa

SEQ ID NO: 290 - RNA, 25 nt, synthetic construct
  misc_feature 1..25: note = Synthetic
  source 1..25: mol_type = other RNA
tttgaggattgctgaattatttctt

SEQ ID NO: 291 - RNA, 30 nt, synthetic construct
  misc_feature 1..30: note = Synthetic
  source 1..30: mol_type = other RNA
cagtttgccgctgcccaatgccatcctgga

SEQ ID NO: 292 - RNA, 30 nt, synthetic construct
  misc_feature 1..30: note = Synthetic
  source 1..30: mol_type = other RNA
ttgccgctgcccaatgccatcctggagttc

SEQ ID NO: 293 - RNA, 25 nt, synthetic construct
  misc_feature 1..25: note = Synthetic
  source 1..25: mol_type = other RNA
tttgccgctgcccaatgccatcctg

SEQ ID NO: 294 - RNA, 22 nt, synthetic construct
  misc_feature 1..22: note = Synthetic
  source 1..22: mol_type = other RNA
ccaatgccatcctggagttcct

SEQ ID NO: 295 - RNA, 29 nt, synthetic construct
  misc_feature 1..29: note = Synthetic
  source 1..29: mol_type = other RNA
cccaatgccatcctggagttcctgtaaga

SEQ ID NO: 296 - RNA, 28 nt, synthetic construct
  misc_feature 1..28: note = Synthetic
  source 1..28: mol_type = other RNA
ccgctgcccaatgccatcctggagttcc

SEQ ID NO: 297 - RNA, 30 nt, synthetic construct
  misc_feature 1..30: note = Synthetic
  source 1..30: mol_type = other RNA
cccaatgccatcctggagttcctgtaagat

SEQ ID NO: 298 - RNA, 30 nt, synthetic construct
  misc_feature 1..30: note = Synthetic
  source 1..30: mol_type = other RNA
ccgctgcccaatgccatcctggagttcctg

SEQ ID NO: 299 - RNA, 30 nt, synthetic construct
  misc_feature 1..30: note = Synthetic
  source 1..30: mol_type = other RNA
tgcccaatgccatcctggagttcctgtaag

SEQ ID NO: 300 - RNA, 28 nt, synthetic construct
  misc_feature 1..28: note = Synthetic
  source 1..28: mol_type = other RNA
cccaatgccatcctggagttcctgtaag

SEQ ID NO: 301 - RNA, 28 nt, synthetic construct
  misc_feature 1..28: note = Synthetic
  source 1..28: mol_type = other RNA
tgcccaatgccatcctggagttcctgta

SEQ ID NO: 302 - RNA, 22 nt, synthetic construct
  misc_feature 1..22: note = Synthetic
  source 1..22: mol_type = other RNA
caatgccatcctggagttcctg

SEQ ID NO: 303 - RNA, 31 nt, synthetic construct
  misc_feature 1..31: note = Synthetic
  source 1..31: mol_type = other RNA
gccgctgcccaatgccatcctggagttcctg

SEQ ID NO: 304 - RNA, 29 nt, synthetic construct
  misc_feature 1..29: note = Synthetic
  source 1..29: mol_type = other RNA
attagatctgtcgccctacctcttttttc

SEQ ID NO: 305 - RNA, 27 nt, synthetic construct
  misc_feature 1..27: note = Synthetic
  source 1..27: mol_type = other RNA
tgtcgccctacctcttttttctgtctg

SEQ ID NO: 306 - RNA, 25 nt, synthetic construct
  misc_feature 1..25: note = Synthetic
  source 1..25: mol_type = other RNA
gcccaatgccatcctggagttcctg

SEQ ID NO: 307 - RNA, 29 nt, synthetic construct
  misc_feature 1..29: note = Synthetic
  source 1..29: mol_type = other RNA
agcctctcgctcactcaccctgcaaagga

SEQ ID NO: 308 - RNA, 29 nt, synthetic construct
  misc_feature 1..29: note = Synthetic
  source 1..29: mol_type = other RNA
ccactcagagctcagatcttctaacttcc

SEQ ID NO: 309 - RNA, 27 nt, synthetic construct
  misc_feature 1..27: note = Synthetic
  source 1..27: mol_type = other RNA
cttccactcagagctcagatcttctaa

SEQ ID NO: 310 - RNA, 25 nt, synthetic construct
  misc_feature 1..25: note = Synthetic
  source 1..25: mol_type = other RNA
gggatccagtatacttacaggctcc

SEQ ID NO: 311 - RNA, 17 nt, synthetic construct
  misc_feature 1..17: note = Synthetic
  source 1..17: mol_type = other RNA
ctcagagctcagatctt

SEQ ID NO: 312 - RNA, 15 nt, synthetic construct
  misc_feature 1..15: note = Synthetic
  source 1..15: mol_type = other RNA
ggctgctttgccctc

SEQ ID NO: 313 - RNA, 27 nt, synthetic construct
  misc_feature 1..27: note = Synthetic
  source 1..27: mol_type = other RNA
ctcagatcttctaacttcctctttaac

SEQ ID NO: 314 - RNA, 29 nt, synthetic construct
  misc_feature 1..29: note = Synthetic
  source 1..29: mol_type = other RNA
ctcagagctcagatcttctaacttcctct

SEQ ID NO: 315 - RNA, 27 nt, synthetic construct
  misc_feature 1..27: note = Synthetic
  source 1..27: mol_type = other RNA
cgccttccactcagagctcagatcttc

SEQ ID NO: 316 - RNA, 27 nt, synthetic construct
  misc_feature 1..27: note = Synthetic
  source 1..27: mol_type = other RNA
tcagctcttgaagtaaacggtttaccg

SEQ ID NO: 317 - RNA, 27 nt, synthetic construct
  misc_feature 1..27: note = Synthetic
  source 1..27: mol_type = other RNA
tttgccctcagctcttgaagtaaacgg

SEQ ID NO: 318 - RNA, 27 nt, synthetic construct
  misc_feature 1..27: note = Synthetic
  source 1..27: mol_type = other RNA
ggctgctttgccctcagctcttgaagt

SEQ ID NO: 319 - RNA, 26 nt, synthetic construct
  misc_feature 1..26: note = Synthetic
  source 1..26: mol_type = other RNA
caggagctaggtcaggctgctttgcc

SEQ ID NO: 320 - RNA, 25 nt, synthetic construct
  misc_feature 1..25: note = Synthetic
  source 1..25: mol_type = other RNA
tccaatagtggtcagtccaggagct

SEQ ID NO: 321 - RNA, 27 nt, synthetic construct
  misc_feature 1..27: note = Synthetic
  source 1..27: mol_type = other RNA
aaagagaatgggatccagtatacttac

SEQ ID NO: 322 - RNA, 27 nt, synthetic construct
  misc_feature 1..27: note = Synthetic
  source 1..27: mol_type = other RNA
aaatagctagagccaaagagaatggga

SEQ ID NO: 323 - RNA, 33 nt, synthetic construct
  misc_feature 1..33: note = Synthetic
  source 1..33: mol_type = other RNA
ggctgctttgccctcagctcttgaagtaaacgg

SEQ ID NO: 324 - RNA, 30 nt, synthetic construct
  misc_feature 1..30: note = Synthetic
  source 1..30: mol_type = other RNA
aggctgctttgccctcagctcttgaagtaa

SEQ ID NO: 325 - RNA, 30 nt, synthetic construct
  misc_feature 1..30: note = Synthetic
  source 1..30: mol_type = other RNA
gtcaggctgctttgccctcagctcttgaag

SEQ ID NO: 326 - RNA, 30 nt, synthetic construct
  misc_feature 1..30: note = Synthetic
  source 1..30: mol_type = other RNA
aggtcaggctgctttgccctcagctcttga

SEQ ID NO: 327 - RNA, 25 nt, synthetic construct
  misc_feature 1..25: note = Synthetic
  source 1..25: mol_type = other RNA
cagagctcagatcttctaacttcct

SEQ ID NO: 328 - RNA, 25 nt, synthetic construct
  misc_feature 1..25: note = Synthetic
  source 1..25: mol_type = other RNA
cttacaggctccaatagtggtcagt

SEQ ID NO: 329 - RNA, 25 nt, synthetic construct
  misc_feature 1..25: note = Synthetic
  source 1..25: mol_type = other RNA
atgggatccagtatacttacaggct

SEQ ID NO: 330 - RNA, 25 nt, synthetic construct
  misc_feature 1..25: note = Synthetic
  source 1..25: mol_type = other RNA
agagaatgggatccagtatacttac

SEQ ID NO: 331 - RNA, 27 nt, synthetic construct
  misc_feature 1..27: note = Synthetic
  source 1..27: mol_type = other RNA
aacttcctctttaacagaaaagcatac

SEQ ID NO: 332 - RNA, 30 nt, synthetic construct
  misc_feature 1..30: note = Synthetic
  source 1..30: mol_type = other RNA
gagcctctcgctcactcaccctgcaaagga

SEQ ID NO: 333 - RNA, 23 nt, synthetic construct
  misc_feature 1..23: note = Synthetic
  source 1..23: mol_type = other RNA
ctcataccttctgcttgatgatc

SEQ ID NO: 334 - RNA, 20 nt, synthetic construct
  misc_feature 1..20: note = Synthetic
  source 1..20: mol_type = other RNA
tcaaggaagatggcatttct

SEQ ID NO: 335 - RNA, 20 nt, synthetic construct
  misc_feature 1..20: note = Synthetic
  source 1..20: mol_type = other RNA
gaaagccagtcggtaagttc

SEQ ID NO: 336 - RNA, 15 nt, synthetic construct
  misc_feature 1..15: note = Synthetic
  source 1..15: mol_type = other RNA
cacccaccatcaccc

SEQ ID NO: 337 - RNA, 23 nt, synthetic construct
  misc_feature 1..23: note = Synthetic
  source 1..23: mol_type = other RNA
cctctgtgattttataacttgat

SEQ ID NO: 338 - RNA, 20 nt, synthetic construct
  misc_feature 1..20: note = Synthetic
  source 1..20: mol_type = other RNA
tgatatcctcaaggtcaccc

SEQ ID NO: 339 - RNA, 30 nt, synthetic construct
  misc_feature 1..30: note = Synthetic
  source 1..30: mol_type = other RNA
ggtacctccaacatcaaggaagatggcatt

SEQ ID NO: 340 - RNA, 26 nt, synthetic construct
  misc_feature 1..26: note = Synthetic
  source 1..26: mol_type = other RNA
atttctagtttggagatggcagtttc

SEQ ID NO: 341 - RNA, 26 nt, synthetic construct
  misc_feature 1..26: note = Synthetic
  source 1..26: mol_type = other RNA
catcaaggaagatggcatttctagtt

SEQ ID NO: 342 - RNA, 26 nt, synthetic construct
  misc_feature 1..26: note = Synthetic
  source 1..26: mol_type = other RNA
gagcaggtacctccaacatcaaggaa

SEQ ID NO: 343 - RNA, 30 nt, synthetic construct
  misc_feature 1..30: note = Synthetic
  source 1..30: mol_type = other RNA
ctccaacatcaaggaagatggcatttctag

SEQ ID NO: 344 - RNA, 25 nt, synthetic construct
  misc_feature 1..25: note = Synthetic
  source 1..25: mol_type = other RNA
accagagtaacagtctgagtaggag

SEQ ID NO: 345 - RNA, 25 nt, synthetic construct
  misc_feature 1..25: note = Synthetic
  source 1..25: mol_type = other RNA
caccagagtaacagtctgagtagga

SEQ ID NO: 346 - RNA, 25 nt, synthetic construct
  misc_feature 1..25: note = Synthetic
  source 1..25: mol_type = other RNA
tcaccagagtaacagtctgagtagg

SEQ ID NO: 347 - RNA, 25 nt, synthetic construct
  misc_feature 1..25: note = Synthetic
  source 1..25: mol_type = other RNA
gtcaccagagtaacagtctgagtag

SEQ ID NO: 348 - RNA, 26 nt, synthetic construct
  misc_feature 1..26: note = Synthetic
  source 1..26: mol_type = other RNA
accagagtaacagtctgagtaggagc

SEQ ID NO: 349 - RNA, 24 nt, synthetic construct
  misc_feature 1..24: note = Synthetic
  source 1..24: mol_type = other RNA
ttctgtccaagcccggttgaaatc

SEQ ID NO: 350 - RNA, 30 nt, synthetic construct
  misc_feature 1..30: note = Synthetic
  source 1..30: mol_type = other RNA
acatcaaggaagatggcatttctagtttgg

SEQ ID NO: 351 - RNA, 25 nt, synthetic construct
  misc_feature 1..25: note = Synthetic
  source 1..25: mol_type = other RNA
acatcaaggaagatggcatttctag

SEQ ID NO: 352 - RNA, 25 nt, synthetic construct
  misc_feature 1..25: note = Synthetic
  source 1..25: mol_type = other RNA
atcattttttctcataccttctgct

SEQ ID NO: 353 - RNA, 21 nt, synthetic construct
  misc_feature 1..21: note = Synthetic
  source 1..21: mol_type = other RNA
cacccaccatcaccctctgtg

SEQ ID NO: 354 - RNA, 22 nt, synthetic construct
  misc_feature 1..22: note = Synthetic
  source 1..22: mol_type = other RNA
atcatctcgttgatatcctcaa

SEQ ID NO: 355 - RNA, 28 nt, synthetic construct
  misc_feature 1..28: note = Synthetic
  source 1..28: mol_type = other RNA
ctccaacatcaaggaagatggcatttct

SEQ ID NO: 356 - RNA, 25 nt, synthetic construct
  misc_feature 1..25: note = Synthetic
  source 1..25: mol_type = other RNA
catcaaggaagatggcatttctagt

SEQ ID NO: 357 - RNA, 36 nt, synthetic construct
  misc_feature 1..36: note = Synthetic
  source 1..36: mol_type = other RNA
atcattttttctcataccttctgctaggagctaaaa

SEQ ID NO: 358 - RNA, 18 nt, synthetic construct
  misc_feature 1..18: note = Synthetic
  source 1..18: mol_type = other RNA
ttgctggtcttgtttttc

SEQ ID NO: 359 - RNA, 16 nt, synthetic construct
  misc_feature 1..16: note = Synthetic
  source 1..16: mol_type = other RNA
ccgtaatgattgttct

SEQ ID NO: 360 - RNA, 18 nt, synthetic construct
  misc_feature 1..18: note = Synthetic
  source 1..18: mol_type = other RNA
gctggtcttgtttttcaa

SEQ ID NO: 361 - RNA, 20 nt, synthetic construct
  misc_feature 1..20: note = Synthetic
  source 1..20: mol_type = other RNA
tggtcttgtttttcaaattt

SEQ ID NO: 362 - RNA, 20 nt, synthetic construct
  misc_feature 1..20: note = Synthetic
  source 1..20: mol_type = other RNA
gtcttgtttttcaaattttg

SEQ ID NO: 363 - RNA, 20 nt, synthetic construct
  misc_feature 1..20: note = Synthetic
  source 1..20: mol_type = other RNA
cttgtttttcaaattttggg

SEQ ID NO: 364 - RNA, 19 nt, synthetic construct
  misc_feature 1..19: note = Synthetic
  source 1..19: mol_type = other RNA
tgtttttcaaattttgggc

SEQ ID NO: 365 - RNA, 33 nt, synthetic construct
  misc_feature 1..33: note = Synthetic
  source 1..33: mol_type = other RNA
tccaactggggacgcctctgttccaaatcctgc

SEQ ID NO: 366 - RNA, 21 nt, synthetic construct
  misc_feature 1..21: note = Synthetic
  source 1..21: mol_type = other RNA
tcctgcattgttgcctgtaag

SEQ ID NO: 367 - RNA, 30 nt, synthetic construct
  misc_feature 1..30: note = Synthetic
  source 1..30: mol_type = other RNA
tccaactggggacgcctctgttccaaatcc

SEQ ID NO: 368 - RNA, 21 nt, synthetic construct
  misc_feature 1..21: note = Synthetic
  source 1..21: mol_type = other RNA
actggggacgcctctgttcca

SEQ ID NO: 369 - RNA, 20 nt, synthetic construct
  misc_feature 1..20: note = Synthetic
  source 1..20: mol_type = other RNA
ccgtaatgattgttctagcc

SEQ ID NO: 370 - RNA, 20 nt, synthetic construct
  misc_feature 1..20: note = Synthetic
  source 1..20: mol_type = other RNA
tgttaaaaaacttacttcga

SEQ ID NO: 371 - RNA, 18 nt, synthetic construct
  misc_feature 1..18: note = Synthetic
  source 1..18: mol_type = other RNA
ctgttgcctccggttctg

SEQ ID NO: 372 - RNA, 18 nt, synthetic construct
  misc_feature 1..18: note = Synthetic
  source 1..18: mol_type = other RNA
ttggctctggcctgtcct

SEQ ID NO: 373 - RNA, 33 nt, synthetic construct
  misc_feature 1..33: note = Synthetic
  source 1..33: mol_type = other RNA
ttcaactgttgcctccggttctgaaggtgttct

SEQ ID NO: 374 - RNA, 25 nt, synthetic construct
  misc_feature 1..25: note = Synthetic
  source 1..25: mol_type = other RNA
tacttcatcccactgattctgaatt

SEQ ID NO: 375 - RNA, 25 nt, synthetic construct
  misc_feature 1..25: note = Synthetic
  source 1..25: mol_type = other RNA
ctgaaggtgttcttgtacttcatcc

SEQ ID NO: 376 - RNA, 25 nt, synthetic construct
  misc_feature 1..25: note = Synthetic
  source 1..25: mol_type = other RNA
ctgttgcctccggttctgaaggtgt

SEQ ID NO: 377 - RNA, 30 nt, synthetic construct
  misc_feature 1..30: note = Synthetic
  source 1..30: mol_type = other RNA
ctgttgcctccggttctgaaggtgttcttg

SEQ ID NO: 378 - RNA, 30 nt, synthetic construct
  misc_feature 1..30: note = Synthetic
  source 1..30: mol_type = other RNA
caactgttgcctccggttctgaaggtgttc

SEQ ID NO: 379 - RNA, 30 nt, synthetic construct
  misc_feature 1..30: note = Synthetic
  source 1..30: mol_type = other RNA
ttgcctccggttctgaaggtgttcttgtac

SEQ ID NO: 380 - RNA, 25 nt, synthetic construct
  misc_feature 1..25: note = Synthetic
  source 1..25: mol_type = other RNA
gttgcctccggttctgaaggtgttc

SEQ ID NO: 381 - RNA, 23 nt, synthetic construct
  misc_feature 1..23: note = Synthetic
  source 1..23: mol_type = other RNA
ctccggttctgaaggtgttcttg

SEQ ID NO: 382 - RNA, 22 nt, synthetic construct
  misc_feature 1..22: note = Synthetic
  source 1..22: mol_type = other RNA
ctccggttctgaaggtgttctt

SEQ ID NO: 383 - RNA, 21 nt, synthetic construct
  misc_feature 1..21: note = Synthetic
  source 1..21: mol_type = other RNA
ctccggttctgaaggtgttct

SEQ ID NO: 384 - RNA, 20 nt, synthetic construct
  misc_feature 1..20: note = Synthetic
  source 1..20: mol_type = other RNA
ctccggttctgaaggtgttc

SEQ ID NO: 385 - RNA, 19 nt, synthetic construct
  misc_feature 1..19: note = Synthetic
  source 1..19: mol_type = other RNA
ctccggttctgaaggtgtt

SEQ ID NO: 386 - RNA, 25 nt, synthetic construct
  misc_feature 1..25: note = Synthetic
  source 1..25: mol_type = other RNA
cattcaactgttgcctccggttctg

SEQ ID NO: 387 - RNA, 24 nt, synthetic construct
  misc_feature 1..24: note = Synthetic
  source 1..24: mol_type = other RNA
ctgttgcctccggttctgaaggtg

SEQ ID NO: 388 - RNA, 31 nt, synthetic construct
  misc_feature 1..31: note = Synthetic
  source 1..31: mol_type = other RNA
cattcaactgttgcctccggttctgaaggtg

SEQ ID NO: 389 - RNA, 21 nt, synthetic construct
  misc_feature 1..21: note = Synthetic
  source 1..21: mol_type = other RNA
tactaaccttggtttctgtga

SEQ ID NO: 390 - RNA, 27 nt, synthetic construct
  misc_feature 1..27: note = Synthetic
  source 1..27: mol_type = other RNA
tgtatagggaccctccttccatgactc

SEQ ID NO: 391 - RNA, 25 nt, synthetic construct
  misc_feature 1..25: note = Synthetic
  source 1..25: mol_type = other RNA
ctaaccttggtttctgtgattttct

SEQ ID NO: 392 - RNA, 27 nt, synthetic construct
  misc_feature 1..27: note = Synthetic
  source 1..27: mol_type = other RNA
ggtatctttgatactaaccttggtttc

SEQ ID NO: 393 - RNA, 22 nt, synthetic construct
  misc_feature 1..22: note = Synthetic
  source 1..22: mol_type = other RNA
attctttcaactagaataaaag

SEQ ID NO: 394 - RNA, 25 nt, synthetic construct
  misc_feature 1..25: note = Synthetic
  source 1..25: mol_type = other RNA
gattctgaattctttcaactagaat

SEQ ID NO: 395 - RNA, 20 nt, synthetic construct
  misc_feature 1..20: note = Synthetic
  source 1..20: mol_type = other RNA
atcccactgattctgaattc

SEQ ID NO: 396 - RNA, 22 nt, synthetic construct
  misc_feature 1..22: note = Synthetic
  source 1..22: mol_type = other RNA
aaccgagaccggacaggattct

SEQ ID NO: 397 - RNA, 26 nt, synthetic construct
  misc_feature 1..26: note = Synthetic
  source 1..26: mol_type = other RNA
ggaagctaaggaagaagctgagcagg

SEQ ID NO: 398 - RNA, 20 nt, synthetic construct
  misc_feature 1..20: note = Synthetic
  source 1..20: mol_type = other RNA
ctgttgcagtaatctatgag

SEQ ID NO: 399 - RNA, 23 nt, synthetic construct
  misc_feature 1..23: note = Synthetic
  source 1..23: mol_type = other RNA
tgccattgtttcatcagctcttt

SEQ ID NO: 400 - RNA, 20 nt, synthetic construct
  misc_feature 1..20: note = Synthetic
  source 1..20: mol_type = other RNA
tgcagtaatctatgagtttc

SEQ ID NO: 401 - RNA, 20 nt, synthetic construct
  misc_feature 1..20: note = Synthetic
  source 1..20: mol_type = other RNA
tcctgtaggacattggcagt

SEQ ID NO: 402-436 - skipped (35 entries)

SEQ ID NO: 437 - DNA, 30 bp, synthetic construct
  misc_feature 1..30: note = Synthetic
  source 1..30: mol_type = other DNA
tgagtaggagctaaaatattttgggttttt

SEQ ID NO: 438 - DNA, 40 bp, synthetic construct
  misc_feature 1..40: note = Synthetic
  source 1..40: mol_type = other DNA
agtaacagtctgagtaggagctaaaatattttgggttttt

SEQ ID NO: 439 - DNA, 30 bp, synthetic construct
  misc_feature 1..30: note = Synthetic
  source 1..30: mol_type = other DNA
ctgagtaggagctaaaatattttgggtttt

SEQ ID NO: 440 - DNA, 30 bp, synthetic construct
  misc_feature 1..30: note = Synthetic
  source 1..30: mol_type = other DNA
tctgagtaggagctaaaatattttgggttt

SEQ ID NO: 441 - DNA, 30 bp, synthetic construct
  misc_feature 1..30: note = Synthetic
  source 1..30: mol_type = other DNA
gtctgagtaggagctaaaatattttgggtt

SEQ ID NO: 442 - DNA, 30 bp, synthetic construct
  misc_feature 1..30: note = Synthetic
  source 1..30: mol_type = other DNA
agtctgagtaggagctaaaatattttgggt

SEQ ID NO: 443 - DNA, 30 bp, synthetic construct
  misc_feature 1..30: note = Synthetic
  source 1..30: mol_type = other DNA
cagtctgagtaggagctaaaatattttggg

SEQ ID NO: 444 - DNA, 25 bp, synthetic construct
  misc_feature 1..25: note = Synthetic
  source 1..25: mol_type = other DNA
tgagtaggagctaaaatattttggg

SEQ ID NO: 445 - DNA, 28 bp, synthetic construct
  misc_feature 1..28: note = Synthetic
  source 1..28: mol_type = other DNA
gtctgagtaggagctaaaatattttggg

SEQ ID NO: 446 - DNA, 26 bp, synthetic construct
  misc_feature 1..26: note = Synthetic
  source 1..26: mol_type = other DNA
ctgagtaggagctaaaatattttggg

SEQ ID NO: 447 - DNA, 30 bp, synthetic construct
  misc_feature 1..30: note = Synthetic
  source 1..30: mol_type = other DNA
acagtctgagtaggagctaaaatattttgg

SEQ ID NO: 448 - DNA, 24 bp, synthetic construct
  misc_feature 1..24: note = Synthetic
  source 1..24: mol_type = other DNA
tgagtaggagctaaaatattttgg

SEQ ID NO: 449 - DNA, 30 bp, synthetic construct
  misc_feature 1..30: note = Synthetic
  source 1..30: mol_type = other DNA
aacagtctgagtaggagctaaaatattttg

SEQ ID NO: 450 - DNA, 30 bp, synthetic construct
  misc_feature 1..30: note = Synthetic
  source 1..30: mol_type = other DNA
taacagtctgagtaggagctaaaatatttt

SEQ ID NO: 451 - DNA, 44 bp, synthetic construct
  misc_feature 1..44: note = Synthetic
  source 1..44: mol_type = other DNA
ttgtgtcaccagagtaacagtctgagtaggagctaaaatatttt

SEQ ID NO: 452 - DNA, 23 bp, synthetic construct
  misc_feature 1..23: note = Synthetic
  source 1..23: mol_type = other DNA
ctgagtaggagctaaaatatttt

SEQ ID NO: 453 - DNA, 30 bp, synthetic construct
  misc_feature 1..30: note = Synthetic
  source 1..30: mol_type = other DNA
gtaacagtctgagtaggagctaaaatattt

SEQ ID NO: 454 - DNA, 40 bp, synthetic construct
  misc_feature 1..40: note = Synthetic
  source 1..40: mol_type = other DNA
tgtcaccagagtaacagtctgagtaggagctaaaatattt

SEQ ID NO: 455 - DNA, 20 bp, synthetic construct
  misc_feature 1..20: note = Synthetic
  source 1..20: mol_type = other DNA
tgagtaggagctaaaatatt

SEQ ID NO: 456 - DNA, 30 bp, synthetic construct
  misc_feature 1..30: note = Synthetic
  source 1..30: mol_type = other DNA
agtaacagtctgagtaggagctaaaatatt

SEQ ID NO: 457 - DNA, 26 bp, synthetic construct
  misc_feature 1..26: note = Synthetic
  source 1..26: mol_type = other DNA
acagtctgagtaggagctaaaatatt

SEQ ID NO: 458 - DNA, 25 bp, synthetic construct
  misc_feature 1..25: note = Synthetic
  source 1..25: mol_type = other DNA
cagtctgagtaggagctaaaatatt

SEQ ID NO: 459 - DNA, 21 bp, synthetic construct
  misc_feature 1..21: note = Synthetic
  source 1..21: mol_type = other DNA
ctgagtaggagctaaaatatt

SEQ ID NO: 460 - DNA, 20 bp, synthetic construct
  misc_feature 1..20: note = Synthetic
  source 1..20: mol_type = other DNA
ctgagtaggagctaaaatat

SEQ ID NO: 461 - DNA, 30 bp, synthetic construct
  misc_feature 1..30: note = Synthetic
  source 1..30: mol_type = other DNA
gagtaacagtctgagtaggagctaaaatat

SEQ ID NO: 462 - DNA, 21 bp, synthetic construct
  misc_feature 1..21: note = Synthetic
  source 1..21: mol_type = other DNA
tctgagtaggagctaaaatat

SEQ ID NO: 463 - DNA, 20 bp, synthetic construct
  misc_feature 1..20: note = Synthetic
  source 1..20: mol_type = other DNA
tctgagtaggagctaaaata

SEQ ID NO: 464 - DNA, 30 bp, synthetic construct
  misc_feature 1..30: note = Synthetic
  source 1..30: mol_type = other DNA
agagtaacagtctgagtaggagctaaaata

SEQ ID NO: 465 - DNA, 35 bp, synthetic construct
  misc_feature 1..35: note = Synthetic
  source 1..35: mol_type = other DNA
tcaccagagtaacagtctgagtaggagctaaaata

SEQ ID NO: 466 - DNA, 20 bp, synthetic construct
  misc_feature 1..20: note = Synthetic
  source 1..20: mol_type = other DNA
gtctgagtaggagctaaaat

SEQ ID NO: 467 - DNA, 30 bp, synthetic construct
  misc_feature 1..30: note = Synthetic
  source 1..30: mol_type = other DNA
cagagtaacagtctgagtaggagctaaaat

SEQ ID NO: 468 - DNA, 20 bp, synthetic construct
  misc_feature 1..20: note = Synthetic
  source 1..20: mol_type = other DNA
agtctgagtaggagctaaaa

SEQ ID NO: 469 - DNA, 30 bp, synthetic construct
  misc_feature 1..30: note = Synthetic
  source 1..30: mol_type = other DNA
ccagagtaacagtctgagtaggagctaaaa

SEQ ID NO: 470 - DNA, 23 bp, synthetic construct
  misc_feature 1..23: note = Synthetic
  source 1..23: mol_type = other DNA
aacagtctgagtaggagctaaaa

SEQ ID NO: 471 - DNA, 44 bp, synthetic construct
  misc_feature 1..44: note = Synthetic
  source 1..44: mol_type = other DNA
cacaggttgtgtcaccagagtaacagtctgagtaggagctaaaa

SEQ ID NO: 472 - DNA, 20 bp, synthetic construct
  misc_feature 1..20: note = Synthetic
  source 1..20: mol_type = other DNA
cagtctgagtaggagctaaa

SEQ ID NO: 473 - DNA, 30 bp, synthetic construct
  misc_feature 1..30: note = Synthetic
  source 1..30: mol_type = other DNA
accagagtaacagtctgagtaggagctaaa

SEQ ID NO: 474 - DNA, 26 bp, synthetic construct
  misc_feature 1..26: note = Synthetic
  source 1..26: mol_type = other DNA
gagtaacagtctgagtaggagctaaa

SEQ ID NO: 475 - DNA, 25 bp, synthetic construct
  misc_feature 1..25: note = Synthetic
  source 1..25: mol_type = other DNA
agtaacagtctgagtaggagctaaa

SEQ ID NO: 476 - DNA, 20 bp, synthetic construct
  misc_feature 1..20: note = Synthetic
  source 1..20: mol_type = other DNA
acagtctgagtaggagctaa

SEQ ID NO: 477 - DNA, 30 bp, synthetic construct
  misc_feature 1..30: note = Synthetic
  source 1..30: mol_type = other DNA
caccagagtaacagtctgagtaggagctaa

SEQ ID NO: 478 - DNA, 20 bp, synthetic construct
  misc_feature 1..20: note = Synthetic
  source 1..20: mol_type = other DNA
aacagtctgagtaggagcta

SEQ ID NO: 479 - DNA, 30 bp, synthetic construct
  misc_feature 1..30: note = Synthetic
  source 1..30: mol_type = other DNA
tcaccagagtaacagtctgagtaggagcta

SEQ ID NO: 480 - DNA, 36 bp, synthetic construct
  misc_feature 1..36: note = Synthetic
  source 1..36: mol_type = other DNA
gttgtgtcaccagagtaacagtctgagtaggagcta

SEQ ID NO: 481 - DNA, 20 bp, synthetic construct
  misc_feature 1..20: note = Synthetic
  source 1..20: mol_type = other DNA
taacagtctgagtaggagct

SEQ ID NO: 482 - DNA, 30 bp, synthetic construct
  misc_feature 1..30: note = Synthetic
  source 1..30: mol_type = other DNA
gtcaccagagtaacagtctgagtaggagct

SEQ ID NO: 483 - DNA, 24 bp, synthetic construct
  misc_feature 1..24: note = Synthetic
  source 1..24: mol_type = other DNA
agagtaacagtctgagtaggagct

SEQ ID NO: 484 - DNA, 25 bp, synthetic construct
  misc_feature 1..25: note = Synthetic
  source 1..25: mol_type = other DNA
cagagtaacagtctgagtaggagct

SEQ ID NO: 485 - DNA, 20 bp, synthetic construct
  misc_feature 1..20: note = Synthetic
  source 1..20: mol_type = other DNA
gtaacagtctgagtaggagc

SEQ ID NO: 486 - DNA, 30 bp, synthetic construct
  misc_feature 1..30: note = Synthetic
  source 1..30: mol_type = other DNA
tgtcaccagagtaacagtctgagtaggagc

SEQ ID NO: 487 - DNA, 24 bp, synthetic construct
  misc_feature 1..24: note = Synthetic
  source 1..24: mol_type = other DNA
cagagtaacagtctgagtaggagc

SEQ ID NO: 488 - DNA, 26 bp, synthetic construct
  misc_feature 1..26: note = Synthetic
  source 1..26: mol_type = other DNA
accagagtaacagtctgagtaggagc

SEQ ID NO: 489 - DNA, 25 bp, synthetic construct
  misc_feature 1..25: note = Synthetic
  source 1..25: mol_type = other DNA
ccagagtaacagtctgagtaggagc

SEQ ID NO: 490 - DNA, 20 bp, synthetic construct
  misc_feature 1..20: note = Synthetic
  source 1..20: mol_type = other DNA
agtaacagtctgagtaggag

SEQ ID NO: 491 - DNA, 30 bp, synthetic construct
  misc_feature 1..30: note = Synthetic
  source 1..30: mol_type = other DNA
gtgtcaccagagtaacagtctgagtaggag

SEQ ID NO: 492 - DNA, 25 bp, synthetic construct
  misc_feature 1..25: note = Synthetic
  source 1..25: mol_type = other DNA
accagagtaacagtctgagtaggag

SEQ ID NO: 493 - DNA, 18 bp, synthetic construct
  misc_feature 1..18: note = Synthetic
  source 1..18: mol_type = other DNA
taacagtctgagtaggag

SEQ ID NO: 494 - DNA, 21 bp, synthetic construct
  misc_feature 1..21: note = Synthetic
  source 1..21: mol_type = other DNA
gagtaacagtctgagtaggag

SEQ ID NO: 495 - DNA, 31 bp, synthetic construct
  misc_feature 1..31: note = Synthetic
  source 1..31: mol_type = other DNA
tgtgtcaccagagtaacagtctgagtaggag

SEQ ID NO: 496 - DNA, 26 bp, synthetic construct
  misc_feature 1..26: note = Synthetic
  source 1..26: mol_type = other DNA
caccagagtaacagtctgagtaggag

SEQ ID NO: 497 - DNA, 29 bp, synthetic construct
  misc_feature 1..29: note = Synthetic
  source 1..29: mol_type = other DNA
tgtcaccagagtaacagtctgagtaggag

SEQ ID NO: 498 - DNA, 28 bp, synthetic construct
  misc_feature 1..28: note = Synthetic
  source 1..28: mol_type = other DNA
gtcaccagagtaacagtctgagtaggag

SEQ ID NO: 499 - DNA, 27 bp, synthetic construct
  misc_feature 1..27: note = Synthetic
  source 1..27: mol_type = other DNA
tcaccagagtaacagtctgagtaggag

SEQ ID NO: 500 - DNA, 23 bp, synthetic construct
  misc_feature 1..23: note = Synthetic
  source 1..23: mol_type = other DNA
cagagtaacagtctgagtaggag

SEQ ID NO: 501 - DNA, 20 bp, synthetic construct
  misc_feature 1..20: note = Synthetic
  source 1..20: mol_type = other DNA
gagtaacagtctgagtagga

SEQ ID NO: 502 - DNA, 30 bp, synthetic construct
  misc_feature 1..30: note = Synthetic
  source 1..30: mol_type = other DNA
tgtgtcaccagagtaacagtctgagtagga

SEQ ID NO: 503 - DNA, 25 bp, synthetic construct
  misc_feature 1..25: note = Synthetic
  source 1..25: mol_type = other DNA
caccagagtaacagtctgagtagga

SEQ ID NO: 504 - DNA, 23 bp, synthetic construct
  misc_feature 1..23: note = Synthetic
  source 1..23: mol_type = other DNA
ccagagtaacagtctgagtagga

SEQ ID NO: 505 - DNA, 20 bp, synthetic construct
  misc_feature 1..20: note = Synthetic
  source 1..20: mol_type = other DNA
agagtaacagtctgagtagg

SEQ ID NO: 506 - DNA, 30 bp, synthetic construct
  misc_feature 1..30: note = Synthetic
  source 1..30: mol_type = other DNA
ttgtgtcaccagagtaacagtctgagtagg

SEQ ID NO: 507 - DNA, 25 bp, synthetic construct
  misc_feature 1..25: note = Synthetic
  source 1..25: mol_type = other DNA
tcaccagagtaacagtctgagtagg

SEQ ID NO: 508 - DNA, 19 bp, synthetic construct
  misc_feature 1..19: note = Synthetic
  source 1..19: mol_type = other DNA
gagtaacagtctgagtagg

SEQ ID NO: 509 - DNA, 20 bp, synthetic construct
  misc_feature 1..20: note = Synthetic
  source 1..20: mol_type = other DNA
cagagtaacagtctgagtag

SEQ ID NO: 510 - DNA, 30 bp, synthetic construct
  misc_feature 1..30: note = Synthetic
  source 1..30: mol_type = other DNA
gttgtgtcaccagagtaacagtctgagtag

SEQ ID NO: 511 - DNA, 25 bp, synthetic construct
  misc_feature 1..25: note = Synthetic
  source 1..25: mol_type = other DNA
gtcaccagagtaacagtctgagtag

SEQ ID NO: 512 - DNA, 26 bp, synthetic construct
  misc_feature 1..26: note = Synthetic
  source 1..26: mol_type = other DNA
tgtcaccagagtaacagtctgagtag

SEQ ID NO: 513 - DNA, 19 bp, synthetic construct
  misc_feature 1..19: note = Synthetic
  source 1..19: mol_type = other DNA
agagtaacagtctgagtag

SEQ ID NO: 514 - DNA, 20 bp, synthetic construct
  misc_feature 1..20: note = Synthetic
  source 1..20: mol_type = other DNA
ccagagtaacagtctgagta

SEQ ID NO: 515 - DNA, 30 bp, synthetic construct
  misc_feature 1..30: note = Synthetic
  source 1..30: mol_type = other DNA
ggttgtgtcaccagagtaacagtctgagta

SEQ ID NO: 516 - DNA, 25 bp, synthetic construct
  misc_feature 1..25: note = Synthetic
  source 1..25: mol_type = other DNA
tgtcaccagagtaacagtctgagta

SEQ ID NO: 517 - DNA, 20 bp, synthetic construct
  misc_feature 1..20: note = Synthetic
  source 1..20: mol_type = other DNA
accagagtaacagtctgagt

SEQ ID NO: 518 - DNA, 30 bp, synthetic construct
  misc_feature 1..30: note = Synthetic
  source 1..30: mol_type = other DNA
aggttgtgtcaccagagtaacagtctgagt

SEQ ID NO: 519 - DNA, 25 bp, synthetic construct
  misc_feature 1..25: note = Synthetic
  source 1..25: mol_type = other DNA
gtgtcaccagagtaacagtctgagt

SEQ ID NO: 520 - DNA, 20 bp, synthetic construct
  misc_feature 1..20: note = Synthetic
  source 1..20: mol_type = other DNA
caccagagtaacagtctgag

SEQ ID NO: 521 - DNA, 30 bp, synthetic construct
  misc_feature 1..30: note = Synthetic
  source 1..30: mol_type = other DNA
caggttgtgtcaccagagtaacagtctgag

SEQ ID NO: 522 - DNA, 25 bp, synthetic construct
  misc_feature 1..25: note = Synthetic
  source 1..25: mol_type = other DNA
tgtgtcaccagagtaacagtctgag

SEQ ID NO: 523 - DNA, 32 bp, synthetic construct
  misc_feature 1..32: note = Synthetic
  source 1..32: mol_type = other DNA
cacaggttgtgtcaccagagtaacagtctgag

SEQ ID NO: 524 - DNA, 20 bp, synthetic construct
  misc_feature 1..20: note = Synthetic
  source 1..20: mol_type = other DNA
tcaccagagtaacagtctga

SEQ ID NO: 525 - DNA, 30 bp, synthetic construct
  misc_feature 1..30: note = Synthetic
  source 1..30: mol_type = other DNA
acaggttgtgtcaccagagtaacagtctga

SEQ ID NO: 526 - DNA, 25 bp, synthetic construct
  misc_feature 1..25: note = Synthetic
  source 1..25: mol_type = other DNA
ttgtgtcaccagagtaacagtctga

SEQ ID NO: 527 - DNA, 20 bp, synthetic construct
  misc_feature 1..20: note = Synthetic
  source 1..20: mol_type = other DNA
gtcaccagagtaacagtctg

SEQ ID NO: 528 - DNA, 30 bp, synthetic construct
  misc_feature 1..30: note = Synthetic
  source 1..30: mol_type = other DNA
cacaggttgtgtcaccagagtaacagtctg

SEQ ID NO: 529 - DNA, 25 bp, synthetic construct
  misc_feature 1..25: note = Synthetic
  source 1..25: mol_type = other DNA
gttgtgtcaccagagtaacagtctg

SEQ ID NO: 530 - DNA, 20 bp, synthetic construct
  misc_feature 1..20: note = Synthetic
  source 1..20: mol_type = other DNA
tgtcaccagagtaacagtct

SEQ ID NO: 531 - DNA, 30 bp, synthetic construct
  misc_feature 1..30: note = Synthetic
  source 1..30: mol_type = other DNA
ccacaggttgtgtcaccagagtaacagtct

SEQ ID NO: 532 - DNA, 25 bp, synthetic construct
  misc_feature 1..25: note = Synthetic
  source 1..25: mol_type = other DNA
ggttgtgtcaccagagtaacagtct

SEQ ID NO: 533 - DNA, 19 bp, synthetic construct
  misc_feature 1..19: note = Synthetic
  source 1..19: mol_type = other DNA
gtcaccagagtaacagtct

SEQ ID NO: 534 - DNA, 34 bp, synthetic construct
  misc_feature 1..34: note = Synthetic
  source 1..34: mol_type = other DNA
gtaaccacaggttgtgtcaccagagtaacagtct

SEQ ID NO: 535 - DNA, 23 bp, synthetic construct
  misc_feature 1..23: note = Synthetic
  source 1..23: mol_type = other DNA
ttgtgtcaccagagtaacagtct

SEQ ID NO: 536 - DNA, 20 bp, synthetic construct
  misc_feature 1..20: note = Synthetic
  source 1..20: mol_type = other DNA
gtgtcaccagagtaacagtc

SEQ ID NO: 537 - DNA, 30 bp, synthetic construct
  misc_feature 1..30: note = Synthetic
  source 1..30: mol_type = other DNA
accacaggttgtgtcaccagagtaacagtc

SEQ ID NO: 538 - DNA, 25 bp, synthetic construct
  misc_feature 1..25: note = Synthetic
  source 1..25: mol_type = other DNA
aggttgtgtcaccagagtaacagtc

SEQ ID NO: 539 - DNA, 21 bp, synthetic construct
  misc_feature 1..21: note = Synthetic
  source 1..21: mol_type = other DNA
tgtgtcaccagagtaacagtc

SEQ ID NO: 540 - DNA, 20 bp, synthetic construct
  misc_feature 1..20: note = Synthetic
  source 1..20: mol_type = other DNA
tgtgtcaccagagtaacagt

SEQ ID NO: 541 - DNA, 30 bp, synthetic construct
  misc_feature 1..30: note = Synthetic
  source 1..30: mol_type = other DNA
aaccacaggttgtgtcaccagagtaacagt

SEQ ID NO: 542 - DNA, 21 bp, synthetic construct
  misc_feature 1..21: note = Synthetic
  source 1..21: mol_type = other DNA
ttgtgtcaccagagtaacagt

SEQ ID NO: 543 - DNA, 25 bp, synthetic construct
  misc_feature 1..25: note = Synthetic
  source 1..25: mol_type = other DNA
caggttgtgtcaccagagtaacagt

SEQ ID NO: 544 - DNA, 19 bp, synthetic construct
  misc_feature 1..19: note = Synthetic
  source 1..19: mol_type = other DNA
gtgtcaccagagtaacagt

SEQ ID NO: 545 - DNA, 20 bp, synthetic construct
  misc_feature 1..20: note = Synthetic
  source 1..20: mol_type = other DNA
ttgtgtcaccagagtaacag

SEQ ID NO: 546 - DNA, 30 bp, synthetic construct
  misc_feature 1..30: note = Synthetic
  source 1..30: mol_type = other DNA
taaccacaggttgtgtcaccagagtaacag

SEQ ID NO: 547 - DNA, 23 bp, synthetic construct
  misc_feature 1..23: note = Synthetic
  source 1..23: mol_type = other DNA
aggttgtgtcaccagagtaacag

SEQ ID NO: 548 - DNA, 25 bp, synthetic construct
  misc_feature 1..25: note = Synthetic
  source 1..25: mol_type = other DNA
acaggttgtgtcaccagagtaacag

SEQ ID NO: 549 - DNA, 20 bp, synthetic construct
  misc_feature 1..20: note = Synthetic
  source 1..20: mol_type = other DNA
gttgtgtcaccagagtaaca

SEQ ID NO: 550 - DNA, 30 bp, synthetic construct
  misc_feature 1..30: note = Synthetic
  source 1..30: mol_type = other DNA
gtaaccacaggttgtgtcaccagagtaaca

SEQ ID NO: 551 - DNA, 25 bp, synthetic construct
  misc_feature 1..25: note = Synthetic
  source 1..25: mol_type = other DNA
cacaggttgtgtcaccagagtaaca

SEQ ID NO: 552 - DNA, 20 bp, synthetic construct
  misc_feature 1..20: note = Synthetic
  source 1..20: mol_type = other DNA
ggttgtgtcaccagagtaac

SEQ ID NO: 553 - DNA, 30 bp, synthetic construct
  misc_feature 1..30: note = Synthetic
  source 1..30: mol_type = other DNA
agtaaccacaggttgtgtcaccagagtaac

SEQ ID NO: 554 - DNA, 25 bp, synthetic construct
  misc_feature 1..25: note = Synthetic
  source 1..25: mol_type = other DNA
ccacaggttgtgtcaccagagtaac

SEQ ID NO: 555 - DNA, 20 bp, synthetic construct
  misc_feature 1..20: note = Synthetic
  source 1..20: mol_type = other DNA
aggttgtgtcaccagagtaa

SEQ ID NO: 556 - DNA, 30 bp, synthetic construct
  misc_feature 1..30: note = Synthetic
  source 1..30: mol_type = other DNA
tagtaaccacaggttgtgtcaccagagtaa

SEQ ID NO: 557 - DNA, 25 bp, synthetic construct
  misc_feature 1..25: note = Synthetic
  source 1..25: mol_type = other DNA
accacaggttgtgtcaccagagtaa

SEQ ID NO: 558 - DNA, 26 bp, synthetic construct
  misc_feature 1..26: note = Synthetic
  source 1..26: mol_type = other DNA
aaccacaggttgtgtcaccagagtaa

SEQ ID NO: 559 - DNA, 20 bp, synthetic construct
  misc_feature 1..20: note = Synthetic
  source 1..20: mol_type = other DNA
caggttgtgtcaccagagta

SEQ ID NO: 560 - DNA, 30 bp, synthetic construct
  misc_feature 1..30: note = Synthetic
  source 1..30: mol_type = other DNA
ttagtaaccacaggttgtgtcaccagagta

SEQ ID NO: 561 - DNA, 25 bp, synthetic construct
  misc_feature 1..25: note = Synthetic
  source 1..25: mol_type = other DNA
aaccacaggttgtgtcaccagagta

SEQ ID NO: 562 - DNA, 20 bp, synthetic construct
  misc_feature 1..20: note = Synthetic
  source 1..20: mol_type = other DNA
acaggttgtgtcaccagagt

SEQ ID NO: 563 - DNA, 30 bp, synthetic construct
  misc_feature 1..30: note = Synthetic
  source 1..30: mol_type = other DNA
cttagtaaccacaggttgtgtcaccagagt

SEQ ID NO: 564 - DNA, 25 bp, synthetic construct
  misc_feature 1..25: note = Synthetic
  source 1..25: mol_type = other DNA
taaccacaggttgtgtcaccagagt

SEQ ID NO: 565 - DNA, 20 bp, synthetic construct
  misc_feature 1..20: note = Synthetic
  source 1..20: mol_type = other DNA
cacaggttgtgtcaccagag

SEQ ID NO: 566 - DNA, 30 bp, synthetic construct
  misc_feature 1..30: note = Synthetic
  source 1..30: mol_type = other DNA
ccttagtaaccacaggttgtgtcaccagag

SEQ ID NO: 567 - DNA, 25 bp, synthetic construct
  misc_feature 1..25: note = Synthetic
  source 1..25: mol_type = other DNA
gtaaccacaggttgtgtcaccagag

SEQ ID NO: 568 - DNA, 20 bp, synthetic construct
  misc_feature 1..20: note = Synthetic
  source 1..20: mol_type = other DNA
ccacaggttgtgtcaccaga

SEQ ID NO: 569 - DNA, 30 bp, synthetic construct
  misc_feature 1..30: note = Synthetic
  source 1..30: mol_type = other DNA
tccttagtaaccacaggttgtgtcaccaga

SEQ ID NO: 570 - DNA, 25 bp, synthetic construct
  misc_feature 1..25: note = Synthetic
  source 1..25: mol_type = other DNA
agtaaccacaggttgtgtcaccaga

SEQ ID NO: 571 - DNA, 20 bp, synthetic construct
  misc_feature 1..20: note = Synthetic
  source 1..20: mol_type = other DNA
accacaggttgtgtcaccag

SEQ ID NO: 572 - DNA, 30 bp, synthetic construct
  misc_feature 1..30: note = Synthetic
  source 1..30: mol_type = other DNA
ttccttagtaaccacaggttgtgtcaccag

SEQ ID NO: 573 - DNA, 19 bp, synthetic construct
  misc_feature 1..19: note = Synthetic
  source 1..19: mol_type = other DNA
ccacaggttgtgtcaccag

SEQ ID NO: 574 - DNA, 25 bp, synthetic construct
  misc_feature 1..25: note = Synthetic
  source 1..25: mol_type = other DNA
tagtaaccacaggttgtgtcaccag

SEQ ID NO: 575 - DNA, 21 bp, synthetic construct
  misc_feature 1..21: note = Synthetic
  source 1..21: mol_type = other DNA
aaccacaggttgtgtcaccag

SEQ ID NO: 576 - DNA, 20 bp, synthetic construct
  misc_feature 1..20: note = Synthetic
  source 1..20: mol_type = other DNA
aaccacaggttgtgtcacca

SEQ ID NO: 577 - DNA, 30 bp, synthetic construct
  misc_feature 1..30: note = Synthetic
  source 1..30: mol_type = other DNA
tttccttagtaaccacaggttgtgtcacca

SEQ ID NO: 578 - DNA, 25 bp, synthetic construct
  misc_feature 1..25: note = Synthetic
  source 1..25: mol_type = other DNA
ttagtaaccacaggttgtgtcacca

SEQ ID NO: 579 - DNA, 20 bp, synthetic construct
  misc_feature 1..20: note = Synthetic
  source 1..20: mol_type = other DNA
taaccacaggttgtgtcacc

SEQ ID NO: 580 - DNA, 30 bp, synthetic construct
  misc_feature 1..30: note = Synthetic
  source 1..30: mol_type = other DNA
gtttccttagtaaccacaggttgtgtcacc

SEQ ID NO: 581 - DNA, 23 bp, synthetic construct
  misc_feature 1..23: note = Synthetic
  source 1..23: mol_type = other DNA
tagtaaccacaggttgtgtcacc

SEQ ID NO: 582 - DNA, 25 bp, synthetic construct
  misc_feature 1..25: note = Synthetic
  source 1..25: mol_type = other DNA
cttagtaaccacaggttgtgtcacc

SEQ ID NO: 583 - DNA, 20 bp, synthetic construct
  misc_feature 1..20: note = Synthetic
  source 1..20: mol_type = other DNA
gtaaccacaggttgtgtcac

SEQ ID NO: 584 - DNA, 30 bp, synthetic construct
  misc_feature 1..30: note = Synthetic
  source 1..30: mol_type = other DNA
agtttccttagtaaccacaggttgtgtcac

SEQ ID NO: 585 - DNA, 25 bp, synthetic construct
  misc_feature 1..25: note = Synthetic
  source 1..25: mol_type = other DNA
ccttagtaaccacaggttgtgtcac

SEQ ID NO: 586 - DNA, 21 bp, synthetic construct
  misc_feature 1..21: note = Synthetic
  source 1..21: mol_type = other DNA
agtaaccacaggttgtgtcac

SEQ ID NO: 587 - DNA, 24 bp, synthetic construct
  misc_feature 1..24: note = Synthetic
  source 1..24: mol_type = other DNA
cttagtaaccacaggttgtgtcac

SEQ ID NO: 588 - DNA, 20 bp, synthetic construct
  misc_feature 1..20: note = Synthetic
  source 1..20: mol_type = other DNA
agtaaccacaggttgtgtca

SEQ ID NO: 589 - DNA, 30 bp, synthetic construct
  misc_feature 1..30: note = Synthetic
  source 1..30: mol_type = other DNA
cagtttccttagtaaccacaggttgtgtca

SEQ ID NO: 590 - DNA, 25 bp, synthetic construct
  misc_feature 1..25: note = Synthetic
  source 1..25: mol_type = other DNA
tccttagtaaccacaggttgtgtca

SEQ ID NO: 591 - DNA, 20 bp, synthetic construct
  misc_feature 1..20: note = Synthetic
  source 1..20: mol_type = other DNA
tagtaaccacaggttgtgtc

SEQ ID NO: 592 - DNA, 30 bp, synthetic construct
  misc_feature 1..30: note = Synthetic
  source 1..30: mol_type = other DNA
gcagtttccttagtaaccacaggttgtgtc

SEQ ID NO: 593 - DNA, 25 bp, synthetic construct
  misc_feature 1..25: note = Synthetic
  source 1..25: mol_type = other DNA
ttccttagtaaccacaggttgtgtc

SEQ ID NO: 594 - DNA, 27 bp, synthetic construct
  misc_feature 1..27: note = Synthetic
  source 1..27: mol_type = other DNA
gtttccttagtaaccacaggttgtgtc

SEQ ID NO: 595 - DNA, 20 bp, synthetic construct
  misc_feature 1..20: note = Synthetic
  source 1..20: mol_type = other DNA
ttagtaaccacaggttgtgt

SEQ ID NO: 596 - DNA, 30 bp, synthetic construct
  misc_feature 1..30: note = Synthetic
  source 1..30: mol_type = other DNA
ggcagtttccttagtaaccacaggttgtgt

SEQ ID NO: 597 - DNA, 25 bp, synthetic construct
  misc_feature 1..25: note = Synthetic
  source 1..25: mol_type = other DNA
tttccttagtaaccacaggttgtgt

SEQ ID NO: 598 - DNA, 20 bp, synthetic construct
  misc_feature 1..20: note = Synthetic
  source 1..20: mol_type = other DNA
cttagtaaccacaggttgtg

SEQ ID NO: 599 - DNA, 30 bp, synthetic construct
  misc_feature 1..30: note = Synthetic
  source 1..30: mol_type = other DNA
tggcagtttccttagtaaccacaggttgtg

SEQ ID NO: 600 - DNA, 25 bp, synthetic construct
  misc_feature 1..25: note = Synthetic
  source 1..25: mol_type = other DNA
gtttccttagtaaccacaggttgtg

SEQ ID NO: 601 - DNA, 20 bp, synthetic construct
  misc_feature 1..20: note = Synthetic
  source 1..20: mol_type = other DNA
ccttagtaaccacaggttgt

SEQ ID NO: 602 - DNA, 30 bp, synthetic construct
  misc_feature 1..30: note = Synthetic
  source 1..30: mol_type = other DNA
atggcagtttccttagtaaccacaggttgt

SEQ ID NO: 603 - DNA, 25 bp, synthetic construct
  misc_feature 1..25: note = Synthetic
  source 1..25: mol_type = other DNA
agtttccttagtaaccacaggttgt

SEQ ID NO: 604 - DNA, 20 bp, synthetic construct
  misc_feature 1..20: note = Synthetic
  source 1..20: mol_type = other DNA
tccttagtaaccacaggttg

SEQ ID NO: 605 - DNA, 30 bp, synthetic construct
  misc_feature 1..30: note = Synthetic
  source 1..30: mol_type = other DNA
gatggcagtttccttagtaaccacaggttg

SEQ ID NO: 606 - DNA, 25 bp, synthetic construct
  misc_feature 1..25: note = Synthetic
  source 1..25: mol_type = other DNA
cagtttccttagtaaccacaggttg

SEQ ID NO: 607 - DNA, 20 bp, synthetic construct
  misc_feature 1..20: note = Synthetic
  source 1..20: mol_type = other DNA
ttccttagtaaccacaggtt

SEQ ID NO: 608 - DNA, 30 bp, synthetic construct
  misc_feature 1..30: note = Synthetic
  source 1..30: mol_type = other DNA
agatggcagtttccttagtaaccacaggtt

SEQ ID NO: 609 - DNA, 25 bp, synthetic construct
  misc_feature 1..25: note = Synthetic
  source 1..25: mol_type = other DNA
gcagtttccttagtaaccacaggtt

SEQ ID NO: 610 - DNA, 21 bp, synthetic construct
  misc_feature 1..21: note = Synthetic
  source 1..21: mol_type = other DNA
tttccttagtaaccacaggtt

SEQ ID NO: 611 - DNA, 20 bp, synthetic construct
  misc_feature 1..20: note = Synthetic
  source 1..20: mol_type = other DNA
tttccttagtaaccacaggt

SEQ ID NO: 612 - DNA, 30 bp, synthetic construct
  misc_feature 1..30: note = Synthetic
  source 1..30: mol_type = other DNA
gagatggcagtttccttagtaaccacaggt

SEQ ID NO: 613 - DNA, 25 bp, synthetic construct
  misc_feature 1..25: note = Synthetic
  source 1..25: mol_type = other DNA
ggcagtttccttagtaaccacaggt

SEQ ID NO: 614 - DNA, 19 bp, synthetic construct
  misc_feature 1..19: note = Synthetic
  source 1..19: mol_type = other DNA
ttccttagtaaccacaggt

SEQ ID NO: 615 - DNA, 26 bp, synthetic construct
  misc_feature 1..26: note = Synthetic
  source 1..26: mol_type = other DNA
tggcagtttccttagtaaccacaggt

SEQ ID NO: 616 - DNA, 20 bp, synthetic construct
  misc_feature 1..20: note = Synthetic
  source 1..20: mol_type = other DNA
gtttccttagtaaccacagg

SEQ ID NO: 617 - DNA, 30 bp, synthetic construct
  misc_feature 1..30: note = Synthetic
  source 1..30: mol_type = other DNA
ggagatggcagtttccttagtaaccacagg

SEQ ID NO: 618 - DNA, 25 bp, synthetic construct
  misc_feature 1..25: note = Synthetic
  source 1..25: mol_type = other DNA
tggcagtttccttagtaaccacagg

SEQ ID NO: 619 - DNA, 20 bp, synthetic construct
  misc_feature 1..20: note = Synthetic
  source 1..20: mol_type = other DNA
agtttccttagtaaccacag

SEQ ID NO: 620 - DNA, 30 bp, synthetic construct
  misc_feature 1..30: note = Synthetic
  source 1..30: mol_type = other DNA
tggagatggcagtttccttagtaaccacag

SEQ ID NO: 621 - DNA, 25 bp, synthetic construct
  misc_feature 1..25: note = Synthetic
  source 1..25: mol_type = other DNA
atggcagtttccttagtaaccacag

SEQ ID NO: 622 - DNA, 19 bp, synthetic construct
  misc_feature 1..19: note = Synthetic
  source 1..19: mol_type = other DNA
gtttccttagtaaccacag

SEQ ID NO: 623 - DNA, 20 bp, synthetic construct
  misc_feature 1..20: note = Synthetic
  source 1..20: mol_type = other DNA
cagtttccttagtaaccaca

SEQ ID NO: 624 - DNA, 30 bp, synthetic construct
  misc_feature 1..30: note = Synthetic
  source 1..30: mol_type = other DNA
ttggagatggcagtttccttagtaaccaca

SEQ ID NO: 625 - DNA, 25 bp, synthetic construct
  misc_feature 1..25: note = Synthetic
  source 1..25: mol_type = other DNA
gatggcagtttccttagtaaccaca

SEQ ID NO: 626 - DNA, 20 bp, synthetic construct
  misc_feature 1..20: note = Synthetic
  source 1..20: mol_type = other DNA
gcagtttccttagtaaccac

SEQ ID NO: 627 - DNA, 30 bp, synthetic construct
  misc_feature 1..30: note = Synthetic
  source 1..30: mol_type = other DNA
tttggagatggcagtttccttagtaaccac

SEQ ID NO: 628 - DNA, 25 bp, synthetic construct
  misc_feature 1..25: note = Synthetic
  source 1..25: mol_type = other DNA
agatggcagtttccttagtaaccac

SEQ ID NO: 629 - DNA, 20 bp, synthetic construct
  misc_feature 1..20: note = Synthetic
  source 1..20: mol_type = other DNA
ggcagtttccttagtaacca

SEQ ID NO: 630 - DNA, 30 bp, synthetic construct
  misc_feature 1..30: note = Synthetic
  source 1..30: mol_type = other DNA
gtttggagatggcagtttccttagtaacca

SEQ ID NO: 631 - DNA, 25 bp, synthetic construct
  misc_feature 1..25: note = Synthetic
  source 1..25: mol_type = other DNA
gagatggcagtttccttagtaacca

SEQ ID NO: 632 - DNA, 20 bp, synthetic construct
  misc_feature 1..20: note = Synthetic
  source 1..20: mol_type = other DNA
tggcagtttccttagtaacc

SEQ ID NO: 633 - DNA, 30 bp, synthetic construct
  misc_feature 1..30: note = Synthetic
  source 1..30: mol_type = other DNA
agtttggagatggcagtttccttagtaacc

SEQ ID NO: 634 - DNA, 23 bp, synthetic construct
  misc_feature 1..23: note = Synthetic
  source 1..23: mol_type = other DNA
agatggcagtttccttagtaacc

SEQ ID NO: 635 - DNA, 25 bp, synthetic construct
  misc_feature 1..25: note = Synthetic
  source 1..25: mol_type = other DNA
ggagatggcagtttccttagtaacc

SEQ ID NO: 636 - DNA, 24 bp, synthetic construct
  misc_feature 1..24: note = Synthetic
  source 1..24: mol_type = other DNA
gagatggcagtttccttagtaacc

SEQ ID NO: 637 - DNA, 20 bp, synthetic construct
  misc_feature 1..20: note = Synthetic
  source 1..20: mol_type = other DNA
atggcagtttccttagtaac

SEQ ID NO: 638 - DNA, 30 bp, synthetic construct
  misc_feature 1..30: note = Synthetic
  source 1..30: mol_type = other DNA
tagtttggagatggcagtttccttagtaac

SEQ ID NO: 639 - DNA, 25 bp, synthetic construct
  misc_feature 1..25: note = Synthetic
  source 1..25: mol_type = other DNA
tggagatggcagtttccttagtaac

SEQ ID NO: 640 - DNA, 19 bp, synthetic construct
  misc_feature 1..19: note = Synthetic
  source 1..19: mol_type = other DNA
tggcagtttccttagtaac

SEQ ID NO: 641 - DNA, 20 bp, synthetic construct
  misc_feature 1..20: note = Synthetic
  source 1..20: mol_type = other DNA
gatggcagtttccttagtaa

SEQ ID NO: 642 - DNA, 30 bp, synthetic construct
  misc_feature 1..30: note = Synthetic
  source 1..30: mol_type = other DNA
ctagtttggagatggcagtttccttagtaa

SEQ ID NO: 643 - DNA, 25 bp, synthetic construct
  misc_feature 1..25: note = Synthetic
  source 1..25: mol_type = other DNA
ttggagatggcagtttccttagtaa

SEQ ID NO: 644 - DNA, 28 bp, synthetic construct
  misc_feature 1..28: note = Synthetic
  source 1..28: mol_type = other DNA
agtttggagatggcagtttccttagtaa

SEQ ID NO: 645 - DNA, 38 bp, synthetic construct
  misc_feature 1..38: note = Synthetic
  source 1..38: mol_type = other DNA
tggcatttctagtttggagatggcagtttccttagtaa

SEQ ID NO: 646 - DNA, 20 bp, synthetic construct
  misc_feature 1..20: note = Synthetic
  source 1..20: mol_type = other DNA
agatggcagtttccttagta

SEQ ID NO: 647 - DNA, 30 bp, synthetic construct
  misc_feature 1..30: note = Synthetic
  source 1..30: mol_type = other DNA
tctagtttggagatggcagtttccttagta

SEQ ID NO: 648 - DNA, 25 bp, synthetic construct
  misc_feature 1..25: note = Synthetic
  source 1..25: mol_type = other DNA
tttggagatggcagtttccttagta

SEQ ID NO: 649 - DNA, 21 bp, synthetic construct
  misc_feature 1..21: note = Synthetic
  source 1..21: mol_type = other DNA
gagatggcagtttccttagta

SEQ ID NO: 650 - DNA, 20 bp, synthetic construct
  misc_feature 1..20: note = Synthetic
  source 1..20: mol_type = other DNA
gagatggcagtttccttagt

SEQ ID NO: 651 - DNA, 30 bp, synthetic construct
  misc_feature 1..30: note = Synthetic
  source 1..30: mol_type = other DNA
ttctagtttggagatggcagtttccttagt

SEQ ID NO: 652 - DNA, 25 bp, synthetic construct
  misc_feature 1..25: note = Synthetic
  source 1..25: mol_type = other DNA
gtttggagatggcagtttccttagt

SEQ ID NO: 653 - DNA, 18 bp, synthetic construct
  misc_feature 1..18: note = Synthetic
  source 1..18: mol_type = other DNA
gatggcagtttccttagt

SEQ ID NO: 654 - DNA, 31 bp, synthetic construct
  misc_feature 1..31: note = Synthetic
  source 1..31: mol_type = other DNA
tttctagtttggagatggcagtttccttagt

SEQ ID NO: 655 - DNA, 20 bp, synthetic construct
  misc_feature 1..20: note = Synthetic
  source 1..20: mol_type = other DNA
ggagatggcagtttccttag

SEQ ID NO: 656 - DNA, 30 bp, synthetic construct
  misc_feature 1..30: note = Synthetic
  source 1..30: mol_type = other DNA
tttctagtttggagatggcagtttccttag

SEQ ID NO: 657 - DNA, 25 bp, synthetic construct
  misc_feature 1..25: note = Synthetic
  source 1..25: mol_type = other DNA
agtttggagatggcagtttccttag

SEQ ID NO: 658 - DNA, 20 bp, synthetic construct
  misc_feature 1..20: note = Synthetic
  source 1..20: mol_type = other DNA
tggagatggcagtttcctta

SEQ ID NO: 659 - DNA, 30 bp, synthetic construct
  misc_feature 1..30: note = Synthetic
  source 1..30: mol_type = other DNA
atttctagtttggagatggcagtttcctta

SEQ ID NO: 660 - DNA, 25 bp, synthetic construct
  misc_feature 1..25: note = Synthetic
  source 1..25: mol_type = other DNA
tagtttggagatggcagtttcctta

SEQ ID NO: 661 - DNA, 20 bp, synthetic construct
  misc_feature 1..20: note = Synthetic
  source 1..20: mol_type = other DNA
ttggagatggcagtttcctt

SEQ ID NO: 662 - DNA, 30 bp, synthetic construct
  misc_feature 1..30: note = Synthetic
  source 1..30: mol_type = other DNA
catttctagtttggagatggcagtttcctt

SEQ ID NO: 663 - DNA, 25 bp, synthetic construct
  misc_feature 1..25: note = Synthetic
  source 1..25: mol_type = other DNA
ctagtttggagatggcagtttcctt

SEQ ID NO: 664 - DNA, 24 bp, synthetic construct
  misc_feature 1..24: note = Synthetic
  source 1..24: mol_type = other DNA
tagtttggagatggcagtttcctt

SEQ ID NO: 665 - DNA, 20 bp, synthetic construct
  misc_feature 1..20: note = Synthetic
  source 1..20: mol_type = other DNA
tttggagatggcagtttcct

SEQ ID NO: 666 - DNA, 30 bp, synthetic construct
  misc_feature 1..30: note = Synthetic
  source 1..30: mol_type = other DNA
gcatttctagtttggagatggcagtttcct

SEQ ID NO: 667 - DNA, 25 bp, synthetic construct
  misc_feature 1..25: note = Synthetic
  source 1..25: mol_type = other DNA
tctagtttggagatggcagtttcct

SEQ ID NO: 668 - DNA, 31 bp, synthetic construct
  misc_feature 1..31: note = Synthetic
  source 1..31: mol_type = other DNA
ggcatttctagtttggagatggcagtttcct

SEQ ID NO: 669 - DNA, 20 bp, synthetic construct
  misc_feature 1..20: note = Synthetic
  source 1..20: mol_type = other DNA
gtttggagatggcagtttcc

SEQ ID NO: 670 - DNA, 30 bp, synthetic construct
  misc_feature 1..30: note = Synthetic
  source 1..30: mol_type = other DNA
ggcatttctagtttggagatggcagtttcc

SEQ ID NO: 671 - DNA, 25 bp, synthetic construct
  misc_feature 1..25: note = Synthetic
  source 1..25: mol_type = other DNA
ttctagtttggagatggcagtttcc

SEQ ID NO: 672 - DNA, 43 bp, synthetic construct
  misc_feature 1..43: note = Synthetic
  source 1..43: mol_type = other DNA
catcaaggaagatggcatttctagtttggagatggcagtttcc

SEQ ID NO: 673 - DNA, 20 bp, synthetic construct
  misc_feature 1..20: note = Synthetic
  source 1..20: mol_type = other DNA
agtttggagatggcagtttc

SEQ ID NO: 674 - DNA, 30 bp, synthetic construct
  misc_feature 1..30: note = Synthetic
  source 1..30: mol_type = other DNA
tggcatttctagtttggagatggcagtttc

SEQ ID NO: 675 - DNA, 25 bp, synthetic construct
  misc_feature 1..25: note = Synthetic
  source 1..25: mol_type = other DNA
tttctagtttggagatggcagtttc

SEQ ID NO: 676 - DNA, 26 bp, synthetic construct
  misc_feature 1..26: note = Synthetic
  source 1..26: mol_type = other DNA
atttctagtttggagatggcagtttc

SEQ ID NO: 677 - DNA, 20 bp, synthetic construct
  misc_feature 1..20: note = Synthetic
  source 1..20: mol_type = other DNA
tagtttggagatggcagttt

SEQ ID NO: 678 - DNA, 30 bp, synthetic construct
  misc_feature 1..30: note = Synthetic
  source 1..30: mol_type = other DNA
atggcatttctagtttggagatggcagttt

SEQ ID NO: 679 - DNA, 25 bp, synthetic construct
  misc_feature 1..25: note = Synthetic
  source 1..25: mol_type = other DNA
atttctagtttggagatggcagttt

SEQ ID NO: 680 - DNA, 20 bp, synthetic construct
  misc_feature 1..20: note = Synthetic
  source 1..20: mol_type = other DNA
ctagtttggagatggcagtt

SEQ ID NO: 681 - DNA, 30 bp, synthetic construct
  misc_feature 1..30: note = Synthetic
  source 1..30: mol_type = other DNA
gatggcatttctagtttggagatggcagtt

SEQ ID NO: 682 - DNA, 25 bp, synthetic construct
  misc_feature 1..25: note = Synthetic
  source 1..25: mol_type = other DNA
catttctagtttggagatggcagtt

SEQ ID NO: 683 - DNA, 18 bp, synthetic construct
  misc_feature 1..18: note = Synthetic
  source 1..18: mol_type = other DNA
agtttggagatggcagtt

SEQ ID NO: 684 - DNA, 20 bp, synthetic construct
  misc_feature 1..20: note = Synthetic
  source 1..20: mol_type = other DNA
tctagtttggagatggcagt

SEQ ID NO: 685 - DNA, 30 bp, synthetic construct
  misc_feature 1..30: note = Synthetic
  source 1..30: mol_type = other DNA
agatggcatttctagtttggagatggcagt

SEQ ID NO: 686 - DNA, 25 bp, synthetic construct
  misc_feature 1..25: note = Synthetic
  source 1..25: mol_type = other DNA
gcatttctagtttggagatggcagt

SEQ ID NO: 687 - DNA, 21 bp, synthetic construct
  misc_feature 1..21: note = Synthetic
  source 1..21: mol_type = other DNA
ttctagtttggagatggcagt

SEQ ID NO: 688 - DNA, 20 bp, synthetic construct
  misc_feature 1..20: note = Synthetic
  source 1..20: mol_type = other DNA
ttctagtttggagatggcag

SEQ ID NO: 689 - DNA, 30 bp, synthetic construct
  misc_feature 1..30: note = Synthetic
  source 1..30: mol_type = other DNA
aagatggcatttctagtttggagatggcag

SEQ ID NO: 690 - DNA, 25 bp, synthetic construct
  misc_feature 1..25: note = Synthetic
  source 1..25: mol_type = other DNA
ggcatttctagtttggagatggcag

SEQ ID NO: 691 - DNA, 26 bp, synthetic construct
  misc_feature 1..26: note = Synthetic
  source 1..26: mol_type = other DNA
tggcatttctagtttggagatggcag

SEQ ID NO: 692 - DNA, 20 bp, synthetic construct
  misc_feature 1..20: note = Synthetic
  source 1..20: mol_type = other DNA
tttctagtttggagatggca

SEQ ID NO: 693 - DNA, 30 bp, synthetic construct
  misc_feature 1..30: note = Synthetic
  source 1..30: mol_type = other DNA
gaagatggcatttctagtttggagatggca

SEQ ID NO: 694 - DNA, 25 bp, synthetic construct
  misc_feature 1..25: note = Synthetic
  source 1..25: mol_type = other DNA
tggcatttctagtttggagatggca

SEQ ID NO: 695 - DNA, 27 bp, synthetic construct
  misc_feature 1..27: note = Synthetic
  source 1..27: mol_type = other DNA
gatggcatttctagtttggagatggca

SEQ ID NO: 696 - DNA, 20 bp, synthetic construct
  misc_feature 1..20: note = Synthetic
  source 1..20: mol_type = other DNA
atttctagtttggagatggc

SEQ ID NO: 697 - DNA, 30 bp, synthetic construct
  misc_feature 1..30: note = Synthetic
  source 1..30: mol_type = other DNA
ggaagatggcatttctagtttggagatggc

SEQ ID NO: 698 - DNA, 25 bp, synthetic construct
  misc_feature 1..25: note = Synthetic
  source 1..25: mol_type = other DNA
atggcatttctagtttggagatggc

SEQ ID NO: 699 - DNA, 20 bp, synthetic construct
  misc_feature 1..20: note = Synthetic
  source 1..20: mol_type = other DNA
catttctagtttggagatgg

SEQ ID NO: 700 - DNA, 30 bp, synthetic construct
  misc_feature 1..30: note = Synthetic
  source 1..30: mol_type = other DNA
aggaagatggcatttctagtttggagatgg

SEQ ID NO: 701 - DNA, 25 bp, synthetic construct
  misc_feature 1..25: note = Synthetic
  source 1..25: mol_type = other DNA
gatggcatttctagtttggagatgg

SEQ ID NO: 702 - DNA, 20 bp, synthetic construct
  misc_feature 1..20: note = Synthetic
  source 1..20: mol_type = other DNA
gcatttctagtttggagatg

SEQ ID NO: 703 - DNA, 30 bp, synthetic construct
  misc_feature 1..30: note = Synthetic
  source 1..30: mol_type = other DNA
aaggaagatggcatttctagtttggagatg

SEQ ID NO: 704 - DNA, 19 bp, synthetic construct
  misc_feature 1..19: note = Synthetic
  source 1..19: mol_type = other DNA
catttctagtttggagatg

SEQ ID NO: 705 - DNA, 25 bp, synthetic construct
  misc_feature 1..25: note = Synthetic
  source 1..25: mol_type = other DNA
agatggcatttctagtttggagatg

SEQ ID NO: 706 - DNA, 21 bp, synthetic construct
  misc_feature 1..21: note = Synthetic
  source 1..21: mol_type = other DNA
ggcatttctagtttggagatg

SEQ ID NO: 707 - DNA, 20 bp, synthetic construct
  misc_feature 1..20: note = Synthetic
  source 1..20: mol_type = other DNA
ggcatttctagtttggagat

SEQ ID NO: 708 - DNA, 30 bp, synthetic construct
  misc_feature 1..30: note = Synthetic
  source 1..30: mol_type = other DNA
caaggaagatggcatttctagtttggagat

SEQ ID NO: 709 - DNA, 25 bp, synthetic construct
  misc_feature 1..25: note = Synthetic
  source 1..25: mol_type = other DNA
aagatggcatttctagtttggagat

SEQ ID NO: 710 - DNA, 29 bp, synthetic construct
  misc_feature 1..29: note = Synthetic
  source 1..29: mol_type = other DNA
aaggaagatggcatttctagtttggagat

SEQ ID NO: 711 - DNA, 20 bp, synthetic construct
  misc_feature 1..20: note = Synthetic
  source 1..20: mol_type = other DNA
tggcatttctagtttggaga

SEQ ID NO: 712 - DNA, 30 bp, synthetic construct
  misc_feature 1..30: note = Synthetic
  source 1..30: mol_type = other DNA
tcaaggaagatggcatttctagtttggaga

SEQ ID NO: 713 - DNA, 25 bp, synthetic construct
  misc_feature 1..25: note = Synthetic
  source 1..25: mol_type = other DNA
gaagatggcatttctagtttggaga

SEQ ID NO: 714 - DNA, 20 bp, synthetic construct
  misc_feature 1..20: note = Synthetic
  source 1..20: mol_type = other DNA
atggcatttctagtttggag

SEQ ID NO: 715 - DNA, 30 bp, synthetic construct
  misc_feature 1..30: note = Synthetic
  source 1..30: mol_type = other DNA
atcaaggaagatggcatttctagtttggag

SEQ ID NO: 716 - DNA, 18 bp, synthetic construct
  misc_feature 1..18: note = Synthetic
  source 1..18: mol_type = other DNA
ggcatttctagtttggag

SEQ ID NO: 717 - DNA, 25 bp, synthetic construct
  misc_feature 1..25: note = Synthetic
  source 1..25: mol_type = other DNA
ggaagatggcatttctagtttggag

SEQ ID NO: 718 - DNA, 45 bp, synthetic construct
  misc_feature 1..45: note = Synthetic
  source 1..45: mol_type = other DNA
gcaggtacctccaacatcaaggaagatggcatttctagtttggag

SEQ ID NO: 719 - DNA, 20 bp, synthetic construct
  misc_feature 1..20: note = Synthetic
  source 1..20: mol_type = other DNA
gatggcatttctagtttgga

SEQ ID NO: 720 - DNA, 30 bp, synthetic construct
  misc_feature 1..30: note = Synthetic
  source 1..30: mol_type = other DNA
catcaaggaagatggcatttctagtttgga

SEQ ID NO: 721 - DNA, 25 bp, synthetic construct
  misc_feature 1..25: note = Synthetic
  source 1..25: mol_type = other DNA
aggaagatggcatttctagtttgga

SEQ ID NO: 722 - DNA, 20 bp, synthetic construct
  misc_feature 1..20: note = Synthetic
  source 1..20: mol_type = other DNA
agatggcatttctagtttgg

SEQ ID NO: 723 - DNA, 30 bp, synthetic construct
  misc_feature 1..30: note = Synthetic
  source 1..30: mol_type = other DNA
acatcaaggaagatggcatttctagtttgg

SEQ ID NO: 724 - DNA, 25 bp, synthetic construct
  misc_feature 1..25: note = Synthetic
  source 1..25: mol_type = other DNA
aaggaagatggcatttctagtttgg

SEQ ID NO: 725 - DNA, 18 bp, synthetic construct
  misc_feature 1..18: note = Synthetic
  source 1..18: mol_type = other DNA
atggcatttctagtttgg

SEQ ID NO: 726 - DNA, 21 bp, synthetic construct
  misc_feature 1..21: note = Synthetic
  source 1..21: mol_type = other DNA
aagatggcatttctagtttgg

SEQ ID NO: 727 - DNA, 22 bp, synthetic construct
  misc_feature 1..22: note = Synthetic
  source 1..22: mol_type = other DNA
gaagatggcatttctagtttgg

SEQ ID NO: 728 - DNA, 23 bp, synthetic construct
  misc_feature 1..23: note = Synthetic
  source 1..23: mol_type = other DNA
ggaagatggcatttctagtttgg

SEQ ID NO: 729 - DNA, 29 bp, synthetic construct
  misc_feature 1..29: note = Synthetic
  source 1..29: mol_type = other DNA
catcaaggaagatggcatttctagtttgg

SEQ ID NO: 730 - DNA, 20 bp, synthetic construct
  misc_feature 1..20: note = Synthetic
  source 1..20: mol_type = other DNA
aagatggcatttctagtttg

SEQ ID NO: 731 - DNA, 30 bp, synthetic construct
  misc_feature 1..30: note = Synthetic
  source 1..30: mol_type = other DNA
aacatcaaggaagatggcatttctagtttg

SEQ ID NO: 732 - DNA, 25 bp, synthetic construct
  misc_feature 1..25: note = Synthetic
  source 1..25: mol_type = other DNA
caaggaagatggcatttctagtttg

SEQ ID NO: 733 - DNA, 42 bp, synthetic construct
  misc_feature 1..42: note = Synthetic
  source 1..42: mol_type = other DNA
gcaggtacctccaacatcaaggaagatggcatttctagtttg

SEQ ID NO: 734 - DNA, 25 bp, synthetic construct
  misc_feature 1..25: note = Synthetic
  source 1..25: mol_type = other DNA
tcaaggaagatggcatttctagttt

SEQ ID NO: 735 - DNA, 30 bp, synthetic construct
  misc_feature 1..30: note = Synthetic
  source 1..30: mol_type = other DNA
caacatcaaggaagatggcatttctagttt

SEQ ID NO: 736 - DNA, 20 bp, synthetic construct
  misc_feature 1..20: note = Synthetic
  source 1..20: mol_type = other DNA
gaagatggcatttctagttt

SEQ ID NO: 737 - DNA, 40 bp, synthetic construct
  misc_feature 1..40: note = Synthetic
  source 1..40: mol_type = other DNA
gcaggtacctccaacatcaaggaagatggcatttctagtt

SEQ ID NO: 738 - DNA, 18 bp, synthetic construct
  misc_feature 1..18: note = Synthetic
  source 1..18: mol_type = other DNA
aagatggcatttctagtt

SEQ ID NO: 739 - DNA, 25 bp, synthetic construct
  misc_feature 1..25: note = Synthetic
  source 1..25: mol_type = other DNA
atcaaggaagatggcatttctagtt

SEQ ID NO: 740 - DNA, 20 bp, synthetic construct
  misc_feature 1..20: note = Synthetic
  source 1..20: mol_type = other DNA
ggaagatggcatttctagtt

SEQ ID NO: 741 - DNA, 26 bp, synthetic construct
  misc_feature 1..26: note = Synthetic
  source 1..26: mol_type = other DNA
catcaaggaagatggcatttctagtt

SEQ ID NO: 742 - DNA, 30 bp, synthetic construct
  misc_feature 1..30: note = Synthetic
  source 1..30: mol_type = other DNA
ccaacatcaaggaagatggcatttctagtt

SEQ ID NO: 743 - DNA, 30 bp, synthetic construct
  misc_feature 1..30: note = Synthetic
  source 1..30: mol_type = other DNA
tccaacatcaaggaagatggcatttctagt

SEQ ID NO: 744 - DNA, 42 bp, synthetic construct
  misc_feature 1..42: note = Synthetic
  source 1..42: mol_type = other DNA
agagcaggtacctccaacatcaaggaagatggcatttctagt

SEQ ID NO: 745 - DNA, 30 bp, synthetic construct
  misc_feature 1..30: note = Synthetic
  source 1..30: mol_type = other DNA
ctccaacatcaaggaagatggcatttctag

SEQ ID NO: 746 - DNA, 30 bp, synthetic construct
  misc_feature 1..30: note = Synthetic
  source 1..30: mol_type = other DNA
cctccaacatcaaggaagatggcatttcta

SEQ ID NO: 747 - DNA, 30 bp, synthetic construct
  misc_feature 1..30: note = Synthetic
  source 1..30: mol_type = other DNA
acctccaacatcaaggaagatggcatttct

SEQ ID NO: 748 - DNA, 35 bp, synthetic construct
  misc_feature 1..35: note = Synthetic
  source 1..35: mol_type = other DNA
caggtacctccaacatcaaggaagatggcatttct

SEQ ID NO: 749 - DNA, 28 bp, synthetic construct
  misc_feature 1..28: note = Synthetic
  source 1..28: mol_type = other DNA
ctccaacatcaaggaagatggcatttct

SEQ ID NO: 750 - DNA, 30 bp, synthetic construct
  misc_feature 1..30: note = Synthetic
  source 1..30: mol_type = other DNA
tacctccaacatcaaggaagatggcatttc

SEQ ID NO: 751 - DNA, 31 bp, synthetic construct
  misc_feature 1..31: note = Synthetic
  source 1..31: mol_type = other DNA
gtacctccaacatcaaggaagatggcatttc

SEQ ID NO: 752 - DNA, 28 bp, synthetic construct
  misc_feature 1..28: note = Synthetic
  source 1..28: mol_type = other DNA
cctccaacatcaaggaagatggcatttc

SEQ ID NO: 753 - DNA, 30 bp, synthetic construct
  misc_feature 1..30: note = Synthetic
  source 1..30: mol_type = other DNA
gtacctccaacatcaaggaagatggcattt

SEQ ID NO: 754 - DNA, 30 bp, synthetic construct
  misc_feature 1..30: note = Synthetic
  source 1..30: mol_type = other DNA
ggtacctccaacatcaaggaagatggcatt

SEQ ID NO: 755 - DNA, 29 bp, synthetic construct
  misc_feature 1..29: note = Synthetic
  source 1..29: mol_type = other DNA
gtacctccaacatcaaggaagatggcatt

SEQ ID NO: 756 - DNA, 25 bp, synthetic construct
  misc_feature 1..25: note = Synthetic
  source 1..25: mol_type = other DNA
ctccaacatcaaggaagatggcatt

SEQ ID NO: 757 - DNA, 30 bp, synthetic construct
  misc_feature 1..30: note = Synthetic
  source 1..30: mol_type = other DNA
aggtacctccaacatcaaggaagatggcat

SEQ ID NO: 758 - DNA, 28 bp, synthetic construct
  misc_feature 1..28: note = Synthetic
  source 1..28: mol_type = other DNA
gtacctccaacatcaaggaagatggcat

SEQ ID NO: 759 - DNA, 25 bp, synthetic construct
  misc_feature 1..25: note = Synthetic
  source 1..25: mol_type = other DNA
cctccaacatcaaggaagatggcat

SEQ ID NO: 760 - DNA, 30 bp, synthetic construct
  misc_feature 1..30: note = Synthetic
  source 1..30: mol_type = other DNA
caggtacctccaacatcaaggaagatggca

SEQ ID NO: 761 - DNA, 25 bp, synthetic construct
  misc_feature 1..25: note = Synthetic
  source 1..25: mol_type = other DNA
acctccaacatcaaggaagatggca

SEQ ID NO: 762 - DNA, 26 bp, synthetic construct
  misc_feature 1..26: note = Synthetic
  source 1..26: mol_type = other DNA
tacctccaacatcaaggaagatggca

SEQ ID NO: 763 - DNA, 27 bp, synthetic construct
  misc_feature 1..27: note = Synthetic
  source 1..27: mol_type = other DNA
gtacctccaacatcaaggaagatggca

SEQ ID NO: 764 - DNA, 30 bp, synthetic construct
  misc_feature 1..30: note = Synthetic
  source 1..30: mol_type = other DNA
gcaggtacctccaacatcaaggaagatggc

SEQ ID NO: 765 - DNA, 25 bp, synthetic construct
  misc_feature 1..25: note = Synthetic
  source 1..25: mol_type = other DNA
tacctccaacatcaaggaagatggc

SEQ ID NO: 766 - DNA, 26 bp, synthetic construct
  misc_feature 1..26: note = Synthetic
  source 1..26: mol_type = other DNA
gtacctccaacatcaaggaagatggc

SEQ ID NO: 767 - DNA, 27 bp, synthetic construct
  misc_feature 1..27: note = Synthetic
  source 1..27: mol_type = other DNA
ggtacctccaacatcaaggaagatggc

SEQ ID NO: 768 - DNA, 29 bp, synthetic construct
  misc_feature 1..29: note = Synthetic
  source 1..29: mol_type = other DNA
caggtacctccaacatcaaggaagatggc

SEQ ID NO: 769 - DNA, 28 bp, synthetic construct
  misc_feature 1..28: note = Synthetic
  source 1..28: mol_type = other DNA
aggtacctccaacatcaaggaagatggc

SEQ ID NO: 770 - DNA, 24 bp, synthetic construct
  misc_feature 1..24: note = Synthetic
  source 1..24: mol_type = other DNA
acctccaacatcaaggaagatggc

SEQ ID NO: 771 - DNA, 23 bp, synthetic construct
  misc_feature 1..23: note = Synthetic
  source 1..23: mol_type = other DNA
cctccaacatcaaggaagatggc

SEQ ID NO: 772 - DNA, 30 bp, synthetic construct
  misc_feature 1..30: note = Synthetic
  source 1..30: mol_type = other DNA
agcaggtacctccaacatcaaggaagatgg

SEQ ID NO: 773 - DNA, 27 bp, synthetic construct
  misc_feature 1..27: note = Synthetic
  source 1..27: mol_type = other DNA
aggtacctccaacatcaaggaagatgg

SEQ ID NO: 774 - DNA, 25 bp, synthetic construct
  misc_feature 1..25: note = Synthetic
  source 1..25: mol_type = other DNA
gtacctccaacatcaaggaagatgg

SEQ ID NO: 775 - DNA, 26 bp, synthetic construct
  misc_feature 1..26: note = Synthetic
  source 1..26: mol_type = other DNA
ggtacctccaacatcaaggaagatgg

SEQ ID NO: 776 - DNA, 21 bp, synthetic construct
  misc_feature 1..21: note = Synthetic
  source 1..21: mol_type = other DNA
ctccaacatcaaggaagatgg

SEQ ID NO: 777 - DNA, 22 bp, synthetic construct
  misc_feature 1..22: note = Synthetic
  source 1..22: mol_type = other DNA
cctccaacatcaaggaagatgg

SEQ ID NO: 778 - DNA, 30 bp, synthetic construct
  misc_feature 1..30: note = Synthetic
  source 1..30: mol_type = other DNA
gagcaggtacctccaacatcaaggaagatg

SEQ ID NO: 779 - DNA, 25 bp, synthetic construct
  misc_feature 1..25: note = Synthetic
  source 1..25: mol_type = other DNA
ggtacctccaacatcaaggaagatg

SEQ ID NO: 780 - DNA, 29 bp, synthetic construct
  misc_feature 1..29: note = Synthetic
  source 1..29: mol_type = other DNA
agcaggtacctccaacatcaaggaagatg

SEQ ID NO: 781 - DNA, 24 bp, synthetic construct
  misc_feature 1..24: note = Synthetic
  source 1..24: mol_type = other DNA
gtacctccaacatcaaggaagatg

SEQ ID NO: 782 - DNA, 21 bp, synthetic construct
  misc_feature 1..21: note = Synthetic
  source 1..21: mol_type = other DNA
cctccaacatcaaggaagatg

SEQ ID NO: 783 - DNA, 20 bp, synthetic construct
  misc_feature 1..20: note = Synthetic
  source 1..20: mol_type = other DNA
ctccaacatcaaggaagatg

SEQ ID NO: 784 - DNA, 30 bp, synthetic construct
  misc_feature 1..30: note = Synthetic
  source 1..30: mol_type = other DNA
agagcaggtacctccaacatcaaggaagat

SEQ ID NO: 785 - DNA, 25 bp, synthetic construct
  misc_feature 1..25: note = Synthetic
  source 1..25: mol_type = other DNA
aggtacctccaacatcaaggaagat

SEQ ID NO: 786 - DNA, 21 bp, synthetic construct
  misc_feature 1..21: note = Synthetic
  source 1..21: mol_type = other DNA
acctccaacatcaaggaagat

SEQ ID NO: 787 - DNA, 23 bp, synthetic construct
  misc_feature 1..23: note = Synthetic
  source 1..23: mol_type = other DNA
gtacctccaacatcaaggaagat

SEQ ID NO: 788 - DNA, 20 bp, synthetic construct
  misc_feature 1..20: note = Synthetic
  source 1..20: mol_type = other DNA
cctccaacatcaaggaagat

SEQ ID NO: 789 - DNA, 20 bp, synthetic construct
  misc_feature 1..20: note = Synthetic
  source 1..20: mol_type = other DNA
acctccaacatcaaggaaga

SEQ ID NO: 790 - DNA, 30 bp, synthetic construct
  misc_feature 1..30: note = Synthetic
  source 1..30: mol_type = other DNA
cagagcaggtacctccaacatcaaggaaga

SEQ ID NO: 791 - DNA, 25 bp, synthetic construct
  misc_feature 1..25: note = Synthetic
  source 1..25: mol_type = other DNA
caggtacctccaacatcaaggaaga

SEQ ID NO: 792 - DNA, 22 bp, synthetic construct
  misc_feature 1..22: note = Synthetic
  source 1..22: mol_type = other DNA
gtacctccaacatcaaggaaga

SEQ ID NO: 793 - DNA, 18 bp, synthetic construct
  misc_feature 1..18: note = Synthetic
  source 1..18: mol_type = other DNA
ctccaacatcaaggaaga

SEQ ID NO: 794 - DNA, 20 bp, synthetic construct
  misc_feature 1..20: note = Synthetic
  source 1..20: mol_type = other DNA
tacctccaacatcaaggaag

SEQ ID NO: 795 - DNA, 30 bp, synthetic construct
  misc_feature 1..30: note = Synthetic
  source 1..30: mol_type = other DNA
ccagagcaggtacctccaacatcaaggaag

SEQ ID NO: 796 - DNA, 25 bp, synthetic construct
  misc_feature 1..25: note = Synthetic
  source 1..25: mol_type = other DNA
gcaggtacctccaacatcaaggaag

SEQ ID NO: 797 - DNA, 27 bp, synthetic construct
  misc_feature 1..27: note = Synthetic
  source 1..27: mol_type = other DNA
gagcaggtacctccaacatcaaggaag

SEQ ID NO: 798 - DNA, 29 bp, synthetic construct
  misc_feature 1..29: note = Synthetic
  source 1..29: mol_type = other DNA
cagagcaggtacctccaacatcaaggaag

SEQ ID NO: 799 - DNA, 21 bp, synthetic construct
  misc_feature 1..21: note = Synthetic
  source 1..21: mol_type = other DNA
gtacctccaacatcaaggaag

SEQ ID NO: 800 - DNA, 20 bp, synthetic construct
  misc_feature 1..20: note = Synthetic
  source 1..20: mol_type = other DNA
gtacctccaacatcaaggaa

SEQ ID NO: 801 - DNA, 30 bp, synthetic construct
  misc_feature 1..30: note = Synthetic
  source 1..30: mol_type = other DNA
gccagagcaggtacctccaacatcaaggaa

SEQ ID NO: 802 - DNA, 25 bp, synthetic construct
  misc_feature 1..25: note = Synthetic
  source 1..25: mol_type = other DNA
agcaggtacctccaacatcaaggaa

SEQ ID NO: 803 - DNA, 26 bp, synthetic construct
  misc_feature 1..26: note = Synthetic
  source 1..26: mol_type = other DNA
gagcaggtacctccaacatcaaggaa

SEQ ID NO: 804 - DNA, 20 bp, synthetic construct
  misc_feature 1..20: note = Synthetic
  source 1..20: mol_type = other DNA
ggtacctccaacatcaagga

SEQ ID NO: 805 - DNA, 30 bp, synthetic construct
  misc_feature 1..30: note = Synthetic
  source 1..30: mol_type = other DNA
tgccagagcaggtacctccaacatcaagga

SEQ ID NO: 806 - DNA, 25 bp, synthetic construct
  misc_feature 1..25: note = Synthetic
  source 1..25: mol_type = other DNA
gagcaggtacctccaacatcaagga

SEQ ID NO: 807 - DNA, 21 bp, synthetic construct
  misc_feature 1..21: note = Synthetic
  source 1..21: mol_type = other DNA
aggtacctccaacatcaagga

SEQ ID NO: 808 - DNA, 20 bp, synthetic construct
  misc_feature 1..20: note = Synthetic
  source 1..20: mol_type = other DNA
aggtacctccaacatcaagg

SEQ ID NO: 809 - DNA, 30 bp, synthetic construct
  misc_feature 1..30: note = Synthetic
  source 1..30: mol_type = other DNA
ctgccagagcaggtacctccaacatcaagg

SEQ ID NO: 810 - DNA, 25 bp, synthetic construct
  misc_feature 1..25: note = Synthetic
  source 1..25: mol_type = other DNA
agagcaggtacctccaacatcaagg

SEQ ID NO: 811 - DNA, 22 bp, synthetic construct
  misc_feature 1..22: note = Synthetic
  source 1..22: mol_type = other DNA
gcaggtacctccaacatcaagg

SEQ ID NO: 812 - DNA, 24 bp, synthetic construct
  misc_feature 1..24: note = Synthetic
  source 1..24: mol_type = other DNA
gagcaggtacctccaacatcaagg

SEQ ID NO: 813 - DNA, 26 bp, synthetic construct
  misc_feature 1..26: note = Synthetic
  source 1..26: mol_type = other DNA
cagagcaggtacctccaacatcaagg

SEQ ID NO: 814 - DNA, 28 bp, synthetic construct
  misc_feature 1..28: note = Synthetic
  source 1..28: mol_type = other DNA
gccagagcaggtacctccaacatcaagg

SEQ ID NO: 815 - DNA, 20 bp, synthetic construct
  misc_feature 1..20: note = Synthetic
  source 1..20: mol_type = other DNA
caggtacctccaacatcaag

SEQ ID NO: 816 - DNA, 30 bp, synthetic construct
  misc_feature 1..30: note = Synthetic
  source 1..30: mol_type = other DNA
tctgccagagcaggtacctccaacatcaag

SEQ ID NO: 817 - DNA, 25 bp, synthetic construct
  misc_feature 1..25: note = Synthetic
  source 1..25: mol_type = other DNA
cagagcaggtacctccaacatcaag

SEQ ID NO: 818 - DNA, 29 bp, synthetic construct
  misc_feature 1..29: note = Synthetic
  source 1..29: mol_type = other DNA
ctgccagagcaggtacctccaacatcaag

SEQ ID NO: 819 - DNA, 23 bp, synthetic construct
  misc_feature 1..23: note = Synthetic
  source 1..23: mol_type = other DNA
gagcaggtacctccaacatcaag

SEQ ID NO: 820 - DNA, 20 bp, synthetic construct
  misc_feature 1..20: note = Synthetic
  source 1..20: mol_type = other DNA
gcaggtacctccaacatcaa

SEQ ID NO: 821 - DNA, 30 bp, synthetic construct
  misc_feature 1..30: note = Synthetic
  source 1..30: mol_type = other DNA
atctgccagagcaggtacctccaacatcaa

SEQ ID NO: 822 - DNA, 25 bp, synthetic construct
  misc_feature 1..25: note = Synthetic
  source 1..25: mol_type = other DNA
ccagagcaggtacctccaacatcaa

SEQ ID NO: 823 - DNA, 20 bp, synthetic construct
  misc_feature 1..20: note = Synthetic
  source 1..20: mol_type = other DNA
agcaggtacctccaacatca

SEQ ID NO: 824 - DNA, 30 bp, synthetic construct
  misc_feature 1..30: note = Synthetic
  source 1..30: mol_type = other DNA
aatctgccagagcaggtacctccaacatca

SEQ ID NO: 825 - DNA, 25 bp, synthetic construct
  misc_feature 1..25: note = Synthetic
  source 1..25: mol_type = other DNA
gccagagcaggtacctccaacatca

SEQ ID NO: 826 - DNA, 20 bp, synthetic construct
  misc_feature 1..20: note = Synthetic
  source 1..20: mol_type = other DNA
gagcaggtacctccaacatc

SEQ ID NO: 827 - DNA, 30 bp, synthetic construct
  misc_feature 1..30: note = Synthetic
  source 1..30: mol_type = other DNA
aaatctgccagagcaggtacctccaacatc

SEQ ID NO: 828 - DNA, 23 bp, synthetic construct
  misc_feature 1..23: note = Synthetic
  source 1..23: mol_type = other DNA
ccagagcaggtacctccaacatc

SEQ ID NO: 829 - DNA, 24 bp, synthetic construct
  misc_feature 1..24: note = Synthetic
  source 1..24: mol_type = other DNA
gccagagcaggtacctccaacatc

SEQ ID NO: 830 - DNA, 25 bp, synthetic construct
  misc_feature 1..25: note = Synthetic
  source 1..25: mol_type = other DNA
tgccagagcaggtacctccaacatc

SEQ ID NO: 831 - DNA, 20 bp, synthetic construct
  misc_feature 1..20: note = Synthetic
  source 1..20: mol_type = other DNA
agagcaggtacctccaacat

SEQ ID NO: 832 - DNA, 30 bp, synthetic construct
  misc_feature 1..30: note = Synthetic
  source 1..30: mol_type = other DNA
gaaatctgccagagcaggtacctccaacat

SEQ ID NO: 833 - DNA, 25 bp, synthetic construct
  misc_feature 1..25: note = Synthetic
  source 1..25: mol_type = other DNA
ctgccagagcaggtacctccaacat

SEQ ID NO: 834 - DNA, 20 bp, synthetic construct
  misc_feature 1..20: note = Synthetic
  source 1..20: mol_type = other DNA
cagagcaggtacctccaaca

SEQ ID NO: 835 - DNA, 30 bp, synthetic construct
  misc_feature 1..30: note = Synthetic
  source 1..30: mol_type = other DNA
tgaaatctgccagagcaggtacctccaaca

SEQ ID NO: 836 - DNA, 25 bp, synthetic construct
  misc_feature 1..25: note = Synthetic
  source 1..25: mol_type = other DNA
tctgccagagcaggtacctccaaca

SEQ ID NO: 837 - DNA, 20 bp, synthetic construct
  misc_feature 1..20: note = Synthetic
  source 1..20: mol_type = other DNA
ccagagcaggtacctccaac

SEQ ID NO: 838 - DNA, 30 bp, synthetic construct
  misc_feature 1..30: note = Synthetic
  source 1..30: mol_type = other DNA
ttgaaatctgccagagcaggtacctccaac

SEQ ID NO: 839 - DNA, 25 bp, synthetic construct
  misc_feature 1..25: note = Synthetic
  source 1..25: mol_type = other DNA
atctgccagagcaggtacctccaac

SEQ ID NO: 840 - DNA, 20 bp, synthetic construct
  misc_feature 1..20: note = Synthetic
  source 1..20: mol_type = other DNA
gccagagcaggtacctccaa

SEQ ID NO: 841 - DNA, 30 bp, synthetic construct
  misc_feature 1..30: note = Synthetic
  source 1..30: mol_type = other DNA
gttgaaatctgccagagcaggtacctccaa

SEQ ID NO: 842 - DNA, 27 bp, synthetic construct
  misc_feature 1..27: note = Synthetic
  source 1..27: mol_type = other DNA
gaaatctgccagagcaggtacctccaa

SEQ ID NO: 843 - DNA, 25 bp, synthetic construct
  misc_feature 1..25: note = Synthetic
  source 1..25: mol_type = other DNA
aatctgccagagcaggtacctccaa

SEQ ID NO: 844 - DNA, 20 bp, synthetic construct
  misc_feature 1..20: note = Synthetic
  source 1..20: mol_type = other DNA
tgccagagcaggtacctcca

SEQ ID NO: 845 - DNA, 30 bp, synthetic construct
  misc_feature 1..30: note = Synthetic
  source 1..30: mol_type = other DNA
ggttgaaatctgccagagcaggtacctcca

SEQ ID NO: 846 - DNA, 21 bp, synthetic construct
  misc_feature 1..21: note = Synthetic
  source 1..21: mol_type = other DNA
ctgccagagcaggtacctcca

SEQ ID NO: 847 - DNA, 25 bp, synthetic construct
  misc_feature 1..25: note = Synthetic
  source 1..25: mol_type = other DNA
aaatctgccagagcaggtacctcca

SEQ ID NO: 848 - DNA, 18 bp, synthetic construct
  misc_feature 1..18: note = Synthetic
  source 1..18: mol_type = other DNA
ccagagcaggtacctcca

SEQ ID NO: 849 - DNA, 20 bp, synthetic construct
  misc_feature 1..20: note = Synthetic
  source 1..20: mol_type = other DNA
ctgccagagcaggtacctcc

SEQ ID NO: 850 - DNA, 30 bp, synthetic construct
  misc_feature 1..30: note = Synthetic
  source 1..30: mol_type = other DNA
cggttgaaatctgccagagcaggtacctcc

SEQ ID NO: 851 - DNA, 25 bp, synthetic construct
  misc_feature 1..25: note = Synthetic
  source 1..25: mol_type = other DNA
gaaatctgccagagcaggtacctcc

SEQ ID NO: 852 - DNA, 20 bp, synthetic construct
  misc_feature 1..20: note = Synthetic
  source 1..20: mol_type = other DNA
tctgccagagcaggtacctc

SEQ ID NO: 853 - DNA, 30 bp, synthetic construct
  misc_feature 1..30: note = Synthetic
  source 1..30: mol_type = other DNA
ccggttgaaatctgccagagcaggtacctc

SEQ ID NO: 854 - DNA, 25 bp, synthetic construct
  misc_feature 1..25: note = Synthetic
  source 1..25: mol_type = other DNA
tgaaatctgccagagcaggtacctc

SEQ ID NO: 855 - DNA, 24 bp, synthetic construct
  misc_feature 1..24: note = Synthetic
  source 1..24: mol_type = other DNA
gaaatctgccagagcaggtacctc

SEQ ID NO: 856 - DNA, 20 bp, synthetic construct
  misc_feature 1..20: note = Synthetic
  source 1..20: mol_type = other DNA
atctgccagagcaggtacct

SEQ ID NO: 857 - DNA, 30 bp, synthetic construct
  misc_feature 1..30: note = Synthetic
  source 1..30: mol_type = other DNA
cccggttgaaatctgccagagcaggtacct

SEQ ID NO: 858 - DNA, 25 bp, synthetic construct
  misc_feature 1..25: note = Synthetic
  source 1..25: mol_type = other DNA
ttgaaatctgccagagcaggtacct

SEQ ID NO: 859 - DNA, 20 bp, synthetic construct
  misc_feature 1..20: note = Synthetic
  source 1..20: mol_type = other DNA
aatctgccagagcaggtacc

SEQ ID NO: 860 - DNA, 30 bp, synthetic construct
  misc_feature 1..30: note = Synthetic
  source 1..30: mol_type = other DNA
gcccggttgaaatctgccagagcaggtacc

SEQ ID NO: 861 - DNA, 25 bp, synthetic construct
  misc_feature 1..25: note = Synthetic
  source 1..25: mol_type = other DNA
gttgaaatctgccagagcaggtacc

SEQ ID NO: 862 - DNA, 30 bp, synthetic construct
  misc_feature 1..30: note = Synthetic
  source 1..30: mol_type = other DNA
agcccggttgaaatctgccagagcaggtac

SEQ ID NO: 863 - DNA, 26 bp, synthetic construct
  misc_feature 1..26: note = Synthetic
  source 1..26: mol_type = other DNA
cggttgaaatctgccagagcaggtac

SEQ ID NO: 864 - DNA, 25 bp, synthetic construct
  misc_feature 1..25: note = Synthetic
  source 1..25: mol_type = other DNA
ggttgaaatctgccagagcaggtac

SEQ ID NO: 865 - DNA, 30 bp, synthetic construct
  misc_feature 1..30: note = Synthetic
  source 1..30: mol_type = other DNA
aagcccggttgaaatctgccagagcaggta

SEQ ID NO: 866 - DNA, 25 bp, synthetic construct
  misc_feature 1..25: note = Synthetic
  source 1..25: mol_type = other DNA
cggttgaaatctgccagagcaggta

SEQ ID NO: 867 - DNA, 30 bp, synthetic construct
  misc_feature 1..30: note = Synthetic
  source 1..30: mol_type = other DNA
caagcccggttgaaatctgccagagcaggt

SEQ ID NO: 868 - DNA, 25 bp, synthetic construct
  misc_feature 1..25: note = Synthetic
  source 1..25: mol_type = other DNA
ccggttgaaatctgccagagcaggt

SEQ ID NO: 869 - DNA, 20 bp, synthetic construct
  misc_feature 1..20: note = Synthetic
  source 1..20: mol_type = other DNA
ttgaaatctgccagagcagg

SEQ ID NO: 870 - DNA, 30 bp, synthetic construct
  misc_feature 1..30: note = Synthetic
  source 1..30: mol_type = other DNA
ccaagcccggttgaaatctgccagagcagg

SEQ ID NO: 871 - DNA, 25 bp, synthetic construct
  misc_feature 1..25: note = Synthetic
  source 1..25: mol_type = other DNA
cccggttgaaatctgccagagcagg

SEQ ID NO: 872 - DNA, 20 bp, synthetic construct
  misc_feature 1..20: note = Synthetic
  source 1..20: mol_type = other DNA
gttgaaatctgccagagcag

SEQ ID NO: 873 - DNA, 30 bp, synthetic construct
  misc_feature 1..30: note = Synthetic
  source 1..30: mol_type = other DNA
tccaagcccggttgaaatctgccagagcag

SEQ ID NO: 874 - DNA, 25 bp, synthetic construct
  misc_feature 1..25: note = Synthetic
  source 1..25: mol_type = other DNA
gcccggttgaaatctgccagagcag

SEQ ID NO: 875 - DNA, 20 bp, synthetic construct
  misc_feature 1..20: note = Synthetic
  source 1..20: mol_type = other DNA
ggttgaaatctgccagagca

SEQ ID NO: 876 - DNA, 30 bp, synthetic construct
  misc_feature 1..30: note = Synthetic
  source 1..30: mol_type = other DNA
gtccaagcccggttgaaatctgccagagca

SEQ ID NO: 877 - DNA, 21 bp, synthetic construct
  misc_feature 1..21: note = Synthetic
  source 1..21: mol_type = other DNA
cggttgaaatctgccagagca

SEQ ID NO: 878 - DNA, 25 bp, synthetic construct
  misc_feature 1..25: note = Synthetic
  source 1..25: mol_type = other DNA
agcccggttgaaatctgccagagca

SEQ ID NO: 879 - DNA, 20 bp, synthetic construct
  misc_feature 1..20: note = Synthetic
  source 1..20: mol_type = other DNA
cggttgaaatctgccagagc

SEQ ID NO: 880 - DNA, 30 bp, synthetic construct
  misc_feature 1..30: note = Synthetic
  source 1..30: mol_type = other DNA
tgtccaagcccggttgaaatctgccagagc

SEQ ID NO: 881 - DNA, 25 bp, synthetic construct
  misc_feature 1..25: note = Synthetic
  source 1..25: mol_type = other DNA
aagcccggttgaaatctgccagagc

SEQ ID NO: 882 - DNA, 20 bp, synthetic construct
  misc_feature 1..20: note = Synthetic
  source 1..20: mol_type = other DNA
ccggttgaaatctgccagag

SEQ ID NO: 883 - DNA, 30 bp, synthetic construct
  misc_feature 1..30: note = Synthetic
  source 1..30: mol_type = other DNA
ctgtccaagcccggttgaaatctgccagag

SEQ ID NO: 884 - DNA, 35 bp, synthetic construct
  misc_feature 1..35: note = Synthetic
  source 1..35: mol_type = other DNA
aagttctgtccaagcccggttgaaatctgccagag

SEQ ID NO: 885 - DNA, 29 bp, synthetic construct
  misc_feature 1..29: note = Synthetic
  source 1..29: mol_type = other DNA
tgtccaagcccggttgaaatctgccagag

SEQ ID NO: 886 - DNA, 25 bp, synthetic construct
  misc_feature 1..25: note = Synthetic
  source 1..25: mol_type = other DNA
caagcccggttgaaatctgccagag

SEQ ID NO: 887 - DNA, 20 bp, synthetic construct
  misc_feature 1..20: note = Synthetic
  source 1..20: mol_type = other DNA
cccggttgaaatctgccaga

SEQ ID NO: 888 - DNA, 30 bp, synthetic construct
  misc_feature 1..30: note = Synthetic
  source 1..30: mol_type = other DNA
tctgtccaagcccggttgaaatctgccaga

SEQ ID NO: 889 - DNA, 25 bp, synthetic construct
  misc_feature 1..25: note = Synthetic
  source 1..25: mol_type = other DNA
ccaagcccggttgaaatctgccaga

SEQ ID NO: 890 - DNA, 20 bp, synthetic construct
  misc_feature 1..20: note = Synthetic
  source 1..20: mol_type = other DNA
gcccggttgaaatctgccag

SEQ ID NO: 891 - DNA, 30 bp, synthetic construct
  misc_feature 1..30: note = Synthetic
  source 1..30: mol_type = other DNA
ttctgtccaagcccggttgaaatctgccag

SEQ ID NO: 892 - DNA, 25 bp, synthetic construct
  misc_feature 1..25: note = Synthetic
  source 1..25: mol_type = other DNA
tccaagcccggttgaaatctgccag

SEQ ID NO: 893 - DNA, 20 bp, synthetic construct
  misc_feature 1..20: note = Synthetic
  source 1..20: mol_type = other DNA
agcccggttgaaatctgcca

SEQ ID NO: 894 - DNA, 30 bp, synthetic construct
  misc_feature 1..30: note = Synthetic
  source 1..30: mol_type = other DNA
gttctgtccaagcccggttgaaatctgcca

SEQ ID NO: 895 - DNA, 25 bp, synthetic construct
  misc_feature 1..25: note = Synthetic
  source 1..25: mol_type = other DNA
gtccaagcccggttgaaatctgcca

SEQ ID NO: 896 - DNA, 20 bp, synthetic construct
  misc_feature 1..20: note = Synthetic
  source 1..20: mol_type = other DNA
aagcccggttgaaatctgcc

SEQ ID NO: 897 - DNA, 30 bp, synthetic construct
  misc_feature 1..30: note = Synthetic
  source 1..30: mol_type = other DNA
agttctgtccaagcccggttgaaatctgcc

SEQ ID NO: 898 - DNA, 25 bp, synthetic construct
  misc_feature 1..25: note = Synthetic
  source 1..25: mol_type = other DNA
tgtccaagcccggttgaaatctgcc

SEQ ID NO: 899 - DNA, 20 bp, synthetic construct
  misc_feature 1..20: note = Synthetic
  source 1..20: mol_type = other DNA
caagcccggttgaaatctgc

SEQ ID NO: 900 - DNA, 30 bp, synthetic construct
  misc_feature 1..30: note = Synthetic
  source 1..30: mol_type = other DNA
aagttctgtccaagcccggttgaaatctgc

SEQ ID NO: 901 - DNA, 25 bp, synthetic construct
  misc_feature 1..25: note = Synthetic
  source 1..25: mol_type = other DNA
ctgtccaagcccggttgaaatctgc

SEQ ID NO: 902 - DNA, 20 bp, synthetic construct
  misc_feature 1..20: note = Synthetic
  source 1..20: mol_type = other DNA
ccaagcccggttgaaatctg

SEQ ID NO: 903 - DNA, 30 bp, synthetic construct
  misc_feature 1..30: note = Synthetic
  source 1..30: mol_type = other DNA
taagttctgtccaagcccggttgaaatctg

SEQ ID NO: 904 - DNA, 25 bp, synthetic construct
  misc_feature 1..25: note = Synthetic
  source 1..25: mol_type = other DNA
tctgtccaagcccggttgaaatctg

SEQ ID NO: 905 - DNA, 20 bp, synthetic construct
  misc_feature 1..20: note = Synthetic
  source 1..20: mol_type = other DNA
tccaagcccggttgaaatct

SEQ ID NO: 906 - DNA, 30 bp, synthetic construct
  misc_feature 1..30: note = Synthetic
  source 1..30: mol_type = other DNA
gtaagttctgtccaagcccggttgaaatct

SEQ ID NO: 907 - DNA, 25 bp, synthetic construct
  misc_feature 1..25: note = Synthetic
  source 1..25: mol_type = other DNA
ttctgtccaagcccggttgaaatct

SEQ ID NO: 908 - DNA, 33 bp, synthetic construct
  misc_feature 1..33: note = Synthetic
  source 1..33: mol_type = other DNA
tcggtaagttctgtccaagcccggttgaaatct

SEQ ID NO: 909 - DNA, 20 bp, synthetic construct
  misc_feature 1..20: note = Synthetic
  source 1..20: mol_type = other DNA
gtccaagcccggttgaaatc

SEQ ID NO: 910 - DNA, 30 bp, synthetic construct
  misc_feature 1..30: note = Synthetic
  source 1..30: mol_type = other DNA
ggtaagttctgtccaagcccggttgaaatc

SEQ ID NO: 911 - DNA, 24 bp, synthetic construct
  misc_feature 1..24: note = Synthetic
  source 1..24: mol_type = other DNA
ttctgtccaagcccggttgaaatc

SEQ ID NO: 912 - DNA, 21 bp, synthetic construct
  misc_feature 1..21: note = Synthetic
  source 1..21: mol_type = other DNA
tgtccaagcccggttgaaatc

SEQ ID NO: 913 - DNA, 25 bp, synthetic construct
  misc_feature 1..25: note = Synthetic
  source 1..25: mol_type = other DNA
gttctgtccaagcccggttgaaatc

SEQ ID NO: 914 - DNA, 20 bp, synthetic construct
  misc_feature 1..20: note = Synthetic
  source 1..20: mol_type = other DNA
tgtccaagcccggttgaaat

SEQ ID NO: 915 - DNA, 30 bp, synthetic construct
  misc_feature 1..30: note = Synthetic
  source 1..30: mol_type = other DNA
cggtaagttctgtccaagcccggttgaaat

SEQ ID NO: 916 - DNA, 25 bp, synthetic construct
  misc_feature 1..25: note = Synthetic
  source 1..25: mol_type = other DNA
agttctgtccaagcccggttgaaat

SEQ ID NO: 917 - DNA, 26 bp, synthetic construct
  misc_feature 1..26: note = Synthetic
  source 1..26: mol_type = other DNA
aagttctgtccaagcccggttgaaat

SEQ ID NO: 918 - DNA, 20 bp, synthetic construct
  misc_feature 1..20: note = Synthetic
  source 1..20: mol_type = other DNA
ctgtccaagcccggttgaaa

SEQ ID NO: 919 - DNA, 30 bp, synthetic construct
  misc_feature 1..30: note = Synthetic
  source 1..30: mol_type = other DNA
tcggtaagttctgtccaagcccggttgaaa

SEQ ID NO: 920 - DNA, 25 bp, synthetic construct
  misc_feature 1..25: note = Synthetic
  source 1..25: mol_type = other DNA
aagttctgtccaagcccggttgaaa

SEQ ID NO: 921 - DNA, 20 bp, synthetic construct
  misc_feature 1..20: note = Synthetic
  source 1..20: mol_type = other DNA
tctgtccaagcccggttgaa

SEQ ID NO: 922 - DNA, 30 bp, synthetic construct
  misc_feature 1..30: note = Synthetic
  source 1..30: mol_type = other DNA
gtcggtaagttctgtccaagcccggttgaa

SEQ ID NO: 923 - DNA, 25 bp, synthetic construct
  misc_feature 1..25: note = Synthetic
  source 1..25: mol_type = other DNA
taagttctgtccaagcccggttgaa

SEQ ID NO: 924 - DNA, 20 bp, synthetic construct
  misc_feature 1..20: note = Synthetic
  source 1..20: mol_type = other DNA
ttctgtccaagcccggttga

SEQ ID NO: 925 - DNA, 30 bp, synthetic construct
  misc_feature 1..30: note = Synthetic
  source 1..30: mol_type = other DNA
agtcggtaagttctgtccaagcccggttga

SEQ ID NO: 926 - DNA, 25 bp, synthetic construct
  misc_feature 1..25: note = Synthetic
  source 1..25: mol_type = other DNA
gtaagttctgtccaagcccggttga

SEQ ID NO: 927 - DNA, 20 bp, synthetic construct
  misc_feature 1..20: note = Synthetic
  source 1..20: mol_type = other DNA
gttctgtccaagcccggttg

SEQ ID NO: 928 - DNA, 30 bp, synthetic construct
  misc_feature 1..30: note = Synthetic
  source 1..30: mol_type = other DNA
cagtcggtaagttctgtccaagcccggttg

SEQ ID NO: 929 - DNA, 25 bp, synthetic construct
  misc_feature 1..25: note = Synthetic
  source 1..25: mol_type = other DNA
ggtaagttctgtccaagcccggttg

SEQ ID NO: 930 - DNA, 22 bp, synthetic construct
  misc_feature 1..22: note = Synthetic
  source 1..22: mol_type = other DNA
aagttctgtccaagcccggttg

SEQ ID NO: 931 - DNA, 20 bp, synthetic construct
  misc_feature 1..20: note = Synthetic
  source 1..20: mol_type = other DNA
agttctgtccaagcccggtt

SEQ ID NO: 932 - DNA, 30 bp, synthetic construct
  misc_feature 1..30: note = Synthetic
  source 1..30: mol_type = other DNA
ccagtcggtaagttctgtccaagcccggtt

SEQ ID NO: 933 - DNA, 25 bp, synthetic construct
  misc_feature 1..25: note = Synthetic
  source 1..25: mol_type = other DNA
cggtaagttctgtccaagcccggtt

SEQ ID NO: 934 - DNA, 24 bp, synthetic construct
  misc_feature 1..24: note = Synthetic
  source 1..24: mol_type = other DNA
ggtaagttctgtccaagcccggtt

SEQ ID NO: 935 - DNA, 20 bp, synthetic construct
  misc_feature 1..20: note = Synthetic
  source 1..20: mol_type = other DNA
aagttctgtccaagcccggt

SEQ ID NO: 936 - DNA, 30 bp, synthetic construct
  misc_feature 1..30: note = Synthetic
  source 1..30: mol_type = other DNA
gccagtcggtaagttctgtccaagcccggt

SEQ ID NO: 937 - DNA, 25 bp, synthetic construct
  misc_feature 1..25: note = Synthetic
  source 1..25: mol_type = other DNA
tcggtaagttctgtccaagcccggt

SEQ ID NO: 938 - DNA, 20 bp, synthetic construct
  misc_feature 1..20: note = Synthetic
  source 1..20: mol_type = other DNA
taagttctgtccaagcccgg

SEQ ID NO: 939 - DNA, 30 bp, synthetic construct
  misc_feature 1..30: note = Synthetic
  source 1..30: mol_type = other DNA
agccagtcggtaagttctgtccaagcccgg

SEQ ID NO: 940 - DNA, 25 bp, synthetic construct
  misc_feature 1..25: note = Synthetic
  source 1..25: mol_type = other DNA
gtcggtaagttctgtccaagcccgg

SEQ ID NO: 941 - DNA, 20 bp, synthetic construct
  misc_feature 1..20: note = Synthetic
  source 1..20: mol_type = other DNA
gtaagttctgtccaagcccg

SEQ ID NO: 942 - DNA, 30 bp, synthetic construct
  misc_feature 1..30: note = Synthetic
  source 1..30: mol_type = other DNA
aagccagtcggtaagttctgtccaagcccg

SEQ ID NO: 943 - DNA, 25 bp, synthetic construct
  misc_feature 1..25: note = Synthetic
  source 1..25: mol_type = other DNA
agtcggtaagttctgtccaagcccg

SEQ ID NO: 944 - DNA, 20 bp, synthetic construct
  misc_feature 1..20: note = Synthetic
  source 1..20: mol_type = other DNA
ggtaagttctgtccaagccc

SEQ ID NO: 945 - DNA, 30 bp, synthetic construct
  misc_feature 1..30: note = Synthetic
  source 1..30: mol_type = other DNA
aaagccagtcggtaagttctgtccaagccc

SEQ ID NO: 946 - DNA, 21 bp, synthetic construct
  misc_feature 1..21: note = Synthetic
  source 1..21: mol_type = other DNA
cggtaagttctgtccaagccc

SEQ ID NO: 947 - DNA, 25 bp, synthetic construct
  misc_feature 1..25: note = Synthetic
  source 1..25: mol_type = other DNA
cagtcggtaagttctgtccaagccc

SEQ ID NO: 948 - DNA, 20 bp, synthetic construct
  misc_feature 1..20: note = Synthetic
  source 1..20: mol_type = other DNA
cggtaagttctgtccaagcc

SEQ ID NO: 949 - DNA, 30 bp, synthetic construct
  misc_feature 1..30: note = Synthetic
  source 1..30: mol_type = other DNA
gaaagccagtcggtaagttctgtccaagcc

SEQ ID NO: 950 - DNA, 25 bp, synthetic construct
  misc_feature 1..25: note = Synthetic
  source 1..25: mol_type = other DNA
ccagtcggtaagttctgtccaagcc

SEQ ID NO: 951 - DNA, 20 bp, synthetic construct
  misc_feature 1..20: note = Synthetic
  source 1..20: mol_type = other DNA
tcggtaagttctgtccaagc

SEQ ID NO: 952 - DNA, 30 bp, synthetic construct
  misc_feature 1..30: note = Synthetic
  source 1..30: mol_type = other DNA
agaaagccagtcggtaagttctgtccaagc

SEQ ID NO: 953 - DNA, 18 bp, synthetic construct
  misc_feature 1..18: note = Synthetic
  source 1..18: mol_type = other DNA
ggtaagttctgtccaagc

SEQ ID NO: 954 - DNA, 25 bp, synthetic construct
  misc_feature 1..25: note = Synthetic
  source 1..25: mol_type = other DNA
gccagtcggtaagttctgtccaagc

SEQ ID NO: 955 - DNA, 20 bp, synthetic construct
  misc_feature 1..20: note = Synthetic
  source 1..20: mol_type = other DNA
gtcggtaagttctgtccaag

SEQ ID NO: 956 - DNA, 30 bp, synthetic construct
  misc_feature 1..30: note = Synthetic
  source 1..30: mol_type = other DNA
gagaaagccagtcggtaagttctgtccaag

SEQ ID NO: 957 - DNA, 23 bp, synthetic construct
  misc_feature 1..23: note = Synthetic
  source 1..23: mol_type = other DNA
ccagtcggtaagttctgtccaag

SEQ ID NO: 958 - DNA, 25 bp, synthetic construct
  misc_feature 1..25: note = Synthetic
  source 1..25: mol_type = other DNA
agccagtcggtaagttctgtccaag

SEQ ID NO: 959 - DNA, 20 bp, synthetic construct
  misc_feature 1..20: note = Synthetic
  source 1..20: mol_type = other DNA
agtcggtaagttctgtccaa

SEQ ID NO: 960 - DNA, 30 bp, synthetic construct
  misc_feature 1..30: note = Synthetic
  source 1..30: mol_type = other DNA
agagaaagccagtcggtaagttctgtccaa

SEQ ID NO: 961 - DNA, 25 bp, synthetic construct
  misc_feature 1..25: note = Synthetic
  source 1..25: mol_type = other DNA
aagccagtcggtaagttctgtccaa

SEQ ID NO: 962 - DNA, 19 bp, synthetic construct
  misc_feature 1..19: note = Synthetic
  source 1..19: mol_type = other DNA
gtcggtaagttctgtccaa

SEQ ID NO: 963 - DNA, 20 bp, synthetic construct
  misc_feature 1..20: note = Synthetic
  source 1..20: mol_type = other DNA
cagtcggtaagttctgtcca

SEQ ID NO: 964 - DNA, 30 bp, synthetic construct
  misc_feature 1..30: note = Synthetic
  source 1..30: mol_type = other DNA
cagagaaagccagtcggtaagttctgtcca

SEQ ID NO: 965 - DNA, 25 bp, synthetic construct
  misc_feature 1..25: note = Synthetic
  source 1..25: mol_type = other DNA
aaagccagtcggtaagttctgtcca

SEQ ID NO: 966 - DNA, 21 bp, synthetic construct
  misc_feature 1..21: note = Synthetic
  source 1..21: mol_type = other DNA
ccagtcggtaagttctgtcca

SEQ ID NO: 967 - DNA, 20 bp, synthetic construct
  misc_feature 1..20: note = Synthetic
  source 1..20: mol_type = other DNA
ccagtcggtaagttctgtcc

SEQ ID NO: 968 - DNA, 30 bp, synthetic construct
  misc_feature 1..30: note = Synthetic
  source 1..30: mol_type = other DNA
gcagagaaagccagtcggtaagttctgtcc

SEQ ID NO: 969 - DNA, 25 bp, synthetic construct
  misc_feature 1..25: note = Synthetic
  source 1..25: mol_type = other DNA
gaaagccagtcggtaagttctgtcc

SEQ ID NO: 970 - DNA, 20 bp, synthetic construct
  misc_feature 1..20: note = Synthetic
  source 1..20: mol_type = other DNA
gccagtcggtaagttctgtc

SEQ ID NO: 971 - DNA, 30 bp, synthetic construct
  misc_feature 1..30: note = Synthetic
  source 1..30: mol_type = other DNA
agcagagaaagccagtcggtaagttctgtc

SEQ ID NO: 972 - DNA, 26 bp, synthetic construct
  misc_feature 1..26: note = Synthetic
  source 1..26: mol_type = other DNA
gagaaagccagtcggtaagttctgtc

SEQ ID NO: 973 - DNA, 25 bp, synthetic construct
  misc_feature 1..25: note = Synthetic
  source 1..25: mol_type = other DNA
agaaagccagtcggtaagttctgtc

SEQ ID NO: 974 - DNA, 20 bp, synthetic construct
  misc_feature 1..20: note = Synthetic
  source 1..20: mol_type = other DNA
agccagtcggtaagttctgt

SEQ ID NO: 975 - DNA, 30 bp, synthetic construct
  misc_feature 1..30: note = Synthetic
  source 1..30: mol_type = other DNA
aagcagagaaagccagtcggtaagttctgt

SEQ ID NO: 976 - DNA, 25 bp, synthetic construct
  misc_feature 1..25: note = Synthetic
  source 1..25: mol_type = other DNA
gagaaagccagtcggtaagttctgt

SEQ ID NO: 977 - DNA, 20 bp, synthetic construct
  misc_feature 1..20: note = Synthetic
  source 1..20: mol_type = other DNA
aagccagtcggtaagttctg

SEQ ID NO: 978 - DNA, 30 bp, synthetic construct
  misc_feature 1..30: note = Synthetic
  source 1..30: mol_type = other DNA
caagcagagaaagccagtcggtaagttctg

SEQ ID NO: 979 - DNA, 25 bp, synthetic construct
  misc_feature 1..25: note = Synthetic
  source 1..25: mol_type = other DNA
agagaaagccagtcggtaagttctg

SEQ ID NO: 980 - DNA, 20 bp, synthetic construct
  misc_feature 1..20: note = Synthetic
  source 1..20: mol_type = other DNA
aaagccagtcggtaagttct

SEQ ID NO: 981 - DNA, 30 bp, synthetic construct
  misc_feature 1..30: note = Synthetic
  source 1..30: mol_type = other DNA
tcaagcagagaaagccagtcggtaagttct

SEQ ID NO: 982 - DNA, 18 bp, synthetic construct
  misc_feature 1..18: note = Synthetic
  source 1..18: mol_type = other DNA
agccagtcggtaagttct

SEQ ID NO: 983 - DNA, 21 bp, synthetic construct
  misc_feature 1..21: note = Synthetic
  source 1..21: mol_type = other DNA
gaaagccagtcggtaagttct

SEQ ID NO: 984 - DNA, 25 bp, synthetic construct
  misc_feature 1..25: note = Synthetic
  source 1..25: mol_type = other DNA
cagagaaagccagtcggtaagttct

SEQ ID NO: 985 - DNA, 20 bp, synthetic construct
  misc_feature 1..20: note = Synthetic
  source 1..20: mol_type = other DNA
gaaagccagtcggtaagttc

SEQ ID NO: 986 - DNA, 30 bp, synthetic construct
  misc_feature 1..30: note = Synthetic
  source 1..30: mol_type = other DNA
atcaagcagagaaagccagtcggtaagttc

SEQ ID NO: 987 - DNA, 23 bp, synthetic construct
  misc_feature 1..23: note = Synthetic
  source 1..23: mol_type = other DNA
agagaaagccagtcggtaagttc

SEQ ID NO: 988 - DNA, 25 bp, synthetic construct
  misc_feature 1..25: note = Synthetic
  source 1..25: mol_type = other DNA
gcagagaaagccagtcggtaagttc

SEQ ID NO: 989 - DNA, 20 bp, synthetic construct
  misc_feature 1..20: note = Synthetic
  source 1..20: mol_type = other DNA
agaaagccagtcggtaagtt

SEQ ID NO: 990 - DNA, 30 bp, synthetic construct
  misc_feature 1..30: note = Synthetic
  source 1..30: mol_type = other DNA
gatcaagcagagaaagccagtcggtaagtt

SEQ ID NO: 991 - DNA, 25 bp, synthetic construct
  misc_feature 1..25: note = Synthetic
  source 1..25: mol_type = other DNA
agcagagaaagccagtcggtaagtt

SEQ ID NO: 992 - DNA, 20 bp, synthetic construct
  misc_feature 1..20: note = Synthetic
  source 1..20: mol_type = other DNA
gagaaagccagtcggtaagt

SEQ ID NO: 993 - DNA, 30 bp, synthetic construct
  misc_feature 1..30: note = Synthetic
  source 1..30: mol_type = other DNA
tgatcaagcagagaaagccagtcggtaagt

SEQ ID NO: 994 - DNA, 25 bp, synthetic construct
  misc_feature 1..25: note = Synthetic
  source 1..25: mol_type = other DNA
aagcagagaaagccagtcggtaagt

SEQ ID NO: 995 - DNA, 20 bp, synthetic construct
  misc_feature 1..20: note = Synthetic
  source 1..20: mol_type = other DNA
agagaaagccagtcggtaag

SEQ ID NO: 996 - DNA, 30 bp, synthetic construct
  misc_feature 1..30: note = Synthetic
  source 1..30: mol_type = other DNA
ttgatcaagcagagaaagccagtcggtaag

SEQ ID NO: 997 - DNA, 25 bp, synthetic construct
  misc_feature 1..25: note = Synthetic
  source 1..25: mol_type = other DNA
caagcagagaaagccagtcggtaag

SEQ ID NO: 998 - DNA, 20 bp, synthetic construct
  misc_feature 1..20: note = Synthetic
  source 1..20: mol_type = other DNA
cagagaaagccagtcggtaa

SEQ ID NO: 999 - DNA, 30 bp, synthetic construct
  misc_feature 1..30: note = Synthetic
  source 1..30: mol_type = other DNA
cttgatcaagcagagaaagccagtcggtaa

SEQ ID NO: 1000 - DNA, 25 bp, synthetic construct
  misc_feature 1..25: note = Synthetic
  source 1..25: mol_type = other DNA
tcaagcagagaaagccagtcggtaa

SEQ ID NO: 1001 - DNA, 21 bp, synthetic construct
  misc_feature 1..21: note = Synthetic
  source 1..21: mol_type = other DNA
gcagagaaagccagtcggtaa

SEQ ID NO: 1002 - DNA, 20 bp, synthetic construct
  misc_feature 1..20: note = Synthetic
  source 1..20: mol_type = other DNA
gcagagaaagccagtcggta

SEQ ID NO: 1003 - DNA, 30 bp, synthetic construct
  misc_feature 1..30: note = Synthetic
  source 1..30: mol_type = other DNA
acttgatcaagcagagaaagccagtcggta

SEQ ID NO: 1004 - DNA, 25 bp, synthetic construct
  misc_feature 1..25: note = Synthetic
  source 1..25: mol_type = other DNA
atcaagcagagaaagccagtcggta

SEQ ID NO: 1005 - DNA, 20 bp, synthetic construct
  misc_feature 1..20: note = Synthetic
  source 1..20: mol_type = other DNA
agcagagaaagccagtcggt

SEQ ID NO: 1006 - DNA, 30 bp, synthetic construct
  misc_feature 1..30: note = Synthetic
  source 1..30: mol_type = other DNA
aacttgatcaagcagagaaagccagtcggt

SEQ ID NO: 1007 - DNA, 25 bp, synthetic construct
  misc_feature 1..25: note = Synthetic
  source 1..25: mol_type = other DNA
gatcaagcagagaaagccagtcggt

SEQ ID NO: 1008 - DNA, 20 bp, synthetic construct
  misc_feature 1..20: note = Synthetic
  source 1..20: mol_type = other DNA
aagcagagaaagccagtcgg

SEQ ID NO: 1009 - DNA, 30 bp, synthetic construct
  misc_feature 1..30: note = Synthetic
  source 1..30: mol_type = other DNA
taacttgatcaagcagagaaagccagtcgg

SEQ ID NO: 1010 - DNA, 45 bp, synthetic construct
  misc_feature 1..45: note = Synthetic
  source 1..45: mol_type = other DNA
ccctctgtgattttataacttgatcaagcagagaaagccagtcgg

SEQ ID NO: 1011 - DNA, 25 bp, synthetic construct
  misc_feature 1..25: note = Synthetic
  source 1..25: mol_type = other DNA
tgatcaagcagagaaagccagtcgg

SEQ ID NO: 1012 - DNA, 20 bp, synthetic construct
  misc_feature 1..20: note = Synthetic
  source 1..20: mol_type = other DNA
caagcagagaaagccagtcg

SEQ ID NO: 1013 - DNA, 30 bp, synthetic construct
  misc_feature 1..30: note = Synthetic
  source 1..30: mol_type = other DNA
ataacttgatcaagcagagaaagccagtcg

SEQ ID NO: 1014 - DNA, 25 bp, synthetic construct
  misc_feature 1..25: note = Synthetic
  source 1..25: mol_type = other DNA
ttgatcaagcagagaaagccagtcg

SEQ ID NO: 1015 - DNA, 20 bp, synthetic construct
  misc_feature 1..20: note = Synthetic
  source 1..20: mol_type = other DNA
tcaagcagagaaagccagtc

SEQ ID NO: 1016 - DNA, 30 bp, synthetic construct
  misc_feature 1..30: note = Synthetic
  source 1..30: mol_type = other DNA
tataacttgatcaagcagagaaagccagtc

SEQ ID NO: 1017 - DNA, 25 bp, synthetic construct
  misc_feature 1..25: note = Synthetic
  source 1..25: mol_type = other DNA
cttgatcaagcagagaaagccagtc

SEQ ID NO: 1018 - DNA, 21 bp, synthetic construct
  misc_feature 1..21: note = Synthetic
  source 1..21: mol_type = other DNA
atcaagcagagaaagccagtc

SEQ ID NO: 1019 - DNA, 20 bp, synthetic construct
  misc_feature 1..20: note = Synthetic
  source 1..20: mol_type = other DNA
atcaagcagagaaagccagt

SEQ ID NO: 1020 - DNA, 30 bp, synthetic construct
  misc_feature 1..30: note = Synthetic
  source 1..30: mol_type = other DNA
ttataacttgatcaagcagagaaagccagt

SEQ ID NO: 1021 - DNA, 25 bp, synthetic construct
  misc_feature 1..25: note = Synthetic
  source 1..25: mol_type = other DNA
acttgatcaagcagagaaagccagt

SEQ ID NO: 1022 - DNA, 20 bp, synthetic construct
  misc_feature 1..20: note = Synthetic
  source 1..20: mol_type = other DNA
gatcaagcagagaaagccag

SEQ ID NO: 1023 - DNA, 30 bp, synthetic construct
  misc_feature 1..30: note = Synthetic
  source 1..30: mol_type = other DNA
tttataacttgatcaagcagagaaagccag

SEQ ID NO: 1024 - DNA, 23 bp, synthetic construct
  misc_feature 1..23: note = Synthetic
  source 1..23: mol_type = other DNA
cttgatcaagcagagaaagccag

SEQ ID NO: 1025 - DNA, 25 bp, synthetic construct
  misc_feature 1..25: note = Synthetic
  source 1..25: mol_type = other DNA
aacttgatcaagcagagaaagccag

SEQ ID NO: 1026 - DNA, 20 bp, synthetic construct
  misc_feature 1..20: note = Synthetic
  source 1..20: mol_type = other DNA
tgatcaagcagagaaagcca

SEQ ID NO: 1027 - DNA, 30 bp, synthetic construct
  misc_feature 1..30: note = Synthetic
  source 1..30: mol_type = other DNA
ttttataacttgatcaagcagagaaagcca

SEQ ID NO: 1028 - DNA, 26 bp, synthetic construct
  misc_feature 1..26: note = Synthetic
  source 1..26: mol_type = other DNA
ataacttgatcaagcagagaaagcca

SEQ ID NO: 1029 - DNA, 25 bp, synthetic construct
  misc_feature 1..25: note = Synthetic
  source 1..25: mol_type = other DNA
taacttgatcaagcagagaaagcca

SEQ ID NO: 1030 - DNA, 20 bp, synthetic construct
  misc_feature 1..20: note = Synthetic
  source 1..20: mol_type = other DNA
ttgatcaagcagagaaagcc

SEQ ID NO: 1031 - DNA, 30 bp, synthetic construct
  misc_feature 1..30: note = Synthetic
  source 1..30: mol_type = other DNA
attttataacttgatcaagcagagaaagcc

SEQ ID NO: 1032 - DNA, 25 bp, synthetic construct
  misc_feature 1..25: note = Synthetic
  source 1..25: mol_type = other DNA
ataacttgatcaagcagagaaagcc

SEQ ID NO: 1033 - DNA, 20 bp, synthetic construct
  misc_feature 1..20: note = Synthetic
  source 1..20: mol_type = other DNA
cttgatcaagcagagaaagc

SEQ ID NO: 1034 - DNA, 30 bp, synthetic construct
  misc_feature 1..30: note = Synthetic
  source 1..30: mol_type = other DNA
gattttataacttgatcaagcagagaaagc

SEQ ID NO: 1035 - DNA, 25 bp, synthetic construct
  misc_feature 1..25: note = Synthetic
  source 1..25: mol_type = other DNA
tataacttgatcaagcagagaaagc

SEQ ID NO: 1036 - DNA, 20 bp, synthetic construct
  misc_feature 1..20: note = Synthetic
  source 1..20: mol_type = other DNA
acttgatcaagcagagaaag

SEQ ID NO: 1037 - DNA, 30 bp, synthetic construct
  misc_feature 1..30: note = Synthetic
  source 1..30: mol_type = other DNA
tgattttataacttgatcaagcagagaaag

SEQ ID NO: 1038 - DNA, 25 bp, synthetic construct
  misc_feature 1..25: note = Synthetic
  source 1..25: mol_type = other DNA
ttataacttgatcaagcagagaaag

SEQ ID NO: 1039 - DNA, 20 bp, synthetic construct
  misc_feature 1..20: note = Synthetic
  source 1..20: mol_type = other DNA
aacttgatcaagcagagaaa

SEQ ID NO: 1040 - DNA, 30 bp, synthetic construct
  misc_feature 1..30: note = Synthetic
  source 1..30: mol_type = other DNA
gtgattttataacttgatcaagcagagaaa

SEQ ID NO: 1041 - DNA, 25 bp, synthetic construct
  misc_feature 1..25: note = Synthetic
  source 1..25: mol_type = other DNA
tttataacttgatcaagcagagaaa

SEQ ID NO: 1042 - DNA, 20 bp, synthetic construct
  misc_feature 1..20: note = Synthetic
  source 1..20: mol_type = other DNA
taacttgatcaagcagagaa

SEQ ID NO: 1043 - DNA, 30 bp, synthetic construct
  misc_feature 1..30: note = Synthetic
  source 1..30: mol_type = other DNA
tgtgattttataacttgatcaagcagagaa

SEQ ID NO: 1044 - DNA, 25 bp, synthetic construct
  misc_feature 1..25: note = Synthetic
  source 1..25: mol_type = other DNA
ttttataacttgatcaagcagagaa

SEQ ID NO: 1045 - DNA, 20 bp, synthetic construct
  misc_feature 1..20: note = Synthetic
  source 1..20: mol_type = other DNA
ataacttgatcaagcagaga

SEQ ID NO: 1046 - DNA, 30 bp, synthetic construct
  misc_feature 1..30: note = Synthetic
  source 1..30: mol_type = other DNA
ctgtgattttataacttgatcaagcagaga

SEQ ID NO: 1047 - DNA, 25 bp, synthetic construct
  misc_feature 1..25: note = Synthetic
  source 1..25: mol_type = other DNA
attttataacttgatcaagcagaga

SEQ ID NO: 1048 - DNA, 30 bp, synthetic construct
  misc_feature 1..30: note = Synthetic
  source 1..30: mol_type = other DNA
tctgtgattttataacttgatcaagcagag

SEQ ID NO: 1049 - DNA, 30 bp, synthetic construct
  misc_feature 1..30: note = Synthetic
  source 1..30: mol_type = other DNA
ctctgtgattttataacttgatcaagcaga

SEQ ID NO: 1050 - DNA, 30 bp, synthetic construct
  misc_feature 1..30: note = Synthetic
  source 1..30: mol_type = other DNA
cctctgtgattttataacttgatcaagcag

SEQ ID NO: 1051 - DNA, 30 bp, synthetic construct
  misc_feature 1..30: note = Synthetic
  source 1..30: mol_type = other DNA
ccctctgtgattttataacttgatcaagca

SEQ ID NO: 1052 - DNA, 30 bp, synthetic construct
  misc_feature 1..30: note = Synthetic
  source 1..30: mol_type = other DNA
accctctgtgattttataacttgatcaagc

SEQ ID NO: 1053 - DNA, 30 bp, synthetic construct
  misc_feature 1..30: note = Synthetic
  source 1..30: mol_type = other DNA
caccctctgtgattttataacttgatcaag

SEQ ID NO: 1054 - DNA, 25 bp, synthetic construct
  misc_feature 1..25: note = Synthetic
  source 1..25: mol_type = other DNA
tctgtgattttataacttgatcaag

SEQ ID NO: 1055 - DNA, 30 bp, synthetic construct
  misc_feature 1..30: note = Synthetic
  source 1..30: mol_type = other DNA
tcaccctctgtgattttataacttgatcaa

SEQ ID NO: 1056 - DNA, 25 bp, synthetic construct
  misc_feature 1..25: note = Synthetic
  source 1..25: mol_type = other DNA
ctctgtgattttataacttgatcaa

SEQ ID NO: 1057 - DNA, 30 bp, synthetic construct
  misc_feature 1..30: note = Synthetic
  source 1..30: mol_type = other DNA
atcaccctctgtgattttataacttgatca

SEQ ID NO: 1058 - DNA, 25 bp, synthetic construct
  misc_feature 1..25: note = Synthetic
  source 1..25: mol_type = other DNA
cctctgtgattttataacttgatca

SEQ ID NO: 1059 - DNA, 30 bp, synthetic construct
  misc_feature 1..30: note = Synthetic
  source 1..30: mol_type = other DNA
catcaccctctgtgattttataacttgatc

SEQ ID NO: 1060 - DNA, 25 bp, synthetic construct
  misc_feature 1..25: note = Synthetic
  source 1..25: mol_type = other DNA
ccctctgtgattttataacttgatc

SEQ ID NO: 1061 - DNA, 30 bp, synthetic construct
  misc_feature 1..30: note = Synthetic
  source 1..30: mol_type = other DNA
ccatcaccctctgtgattttataacttgat

SEQ ID NO: 1062 - DNA, 23 bp, synthetic construct
  misc_feature 1..23: note = Synthetic
  source 1..23: mol_type = other DNA
cctctgtgattttataacttgat

SEQ ID NO: 1063 - DNA, 26 bp, synthetic construct
  misc_feature 1..26: note = Synthetic
  source 1..26: mol_type = other DNA
caccctctgtgattttataacttgat

SEQ ID NO: 1064 - DNA, 25 bp, synthetic construct
  misc_feature 1..25: note = Synthetic
  source 1..25: mol_type = other DNA
accctctgtgattttataacttgat

SEQ ID NO: 1065 - DNA, 20 bp, synthetic construct
  misc_feature 1..20: note = Synthetic
  source 1..20: mol_type = other DNA
tctgtgattttataacttga

SEQ ID NO: 1066 - DNA, 30 bp, synthetic construct
  misc_feature 1..30: note = Synthetic
  source 1..30: mol_type = other DNA
accatcaccctctgtgattttataacttga

SEQ ID NO: 1067 - DNA, 21 bp, synthetic construct
  misc_feature 1..21: note = Synthetic
  source 1..21: mol_type = other DNA
ctctgtgattttataacttga

SEQ ID NO: 1068 - DNA, 25 bp, synthetic construct
  misc_feature 1..25: note = Synthetic
  source 1..25: mol_type = other DNA
caccctctgtgattttataacttga

SEQ ID NO: 1069 - DNA, 20 bp, synthetic construct
  misc_feature 1..20: note = Synthetic
  source 1..20: mol_type = other DNA
ctctgtgattttataacttg

SEQ ID NO: 1070 - DNA, 30 bp, synthetic construct
  misc_feature 1..30: note = Synthetic
  source 1..30: mol_type = other DNA
caccatcaccctctgtgattttataacttg

SEQ ID NO: 1071 - DNA, 21 bp, synthetic construct
  misc_feature 1..21: note = Synthetic
  source 1..21: mol_type = other DNA
cctctgtgattttataacttg

SEQ ID NO: 1072 - DNA, 25 bp, synthetic construct
  misc_feature 1..25: note = Synthetic
  source 1..25: mol_type = other DNA
tcaccctctgtgattttataacttg

SEQ ID NO: 1073 - DNA, 20 bp, synthetic construct
  misc_feature 1..20: note = Synthetic
  source 1..20: mol_type = other DNA
cctctgtgattttataactt

SEQ ID NO: 1074 - DNA, 30 bp, synthetic construct
  misc_feature 1..30: note = Synthetic
  source 1..30: mol_type = other DNA
ccaccatcaccctctgtgattttataactt

SEQ ID NO: 1075 - DNA, 23 bp, synthetic construct
  misc_feature 1..23: note = Synthetic
  source 1..23: mol_type = other DNA
caccctctgtgattttataactt

SEQ ID NO: 1076 - DNA, 25 bp, synthetic construct
  misc_feature 1..25: note = Synthetic
  source 1..25: mol_type = other DNA
atcaccctctgtgattttataactt

SEQ ID NO: 1077 - DNA, 20 bp, synthetic construct
  misc_feature 1..20: note = Synthetic
  source 1..20: mol_type = other DNA
ccctctgtgattttataact

SEQ ID NO: 1078 - DNA, 30 bp, synthetic construct
  misc_feature 1..30: note = Synthetic
  source 1..30: mol_type = other DNA
cccaccatcaccctctgtgattttataact

SEQ ID NO: 1079 - DNA, 25 bp, synthetic construct
  misc_feature 1..25: note = Synthetic
  source 1..25: mol_type = other DNA
catcaccctctgtgattttataact

SEQ ID NO: 1080 - DNA, 20 bp, synthetic construct
  misc_feature 1..20: note = Synthetic
  source 1..20: mol_type = other DNA
accctctgtgattttataac

SEQ ID NO: 1081 - DNA, 30 bp, synthetic construct
  misc_feature 1..30: note = Synthetic
  source 1..30: mol_type = other DNA
acccaccatcaccctctgtgattttataac

SEQ ID NO: 1082 - DNA, 25 bp, synthetic construct
  misc_feature 1..25: note = Synthetic
  source 1..25: mol_type = other DNA
ccatcaccctctgtgattttataac

SEQ ID NO: 1083 - DNA, 20 bp, synthetic construct
  misc_feature 1..20: note = Synthetic
  source 1..20: mol_type = other DNA
caccctctgtgattttataa

SEQ ID NO: 1084 - DNA, 30 bp, synthetic construct
  misc_feature 1..30: note = Synthetic
  source 1..30: mol_type = other DNA
cacccaccatcaccctctgtgattttataa

SEQ ID NO: 1085 - DNA, 25 bp, synthetic construct
  misc_feature 1..25: note = Synthetic
  source 1..25: mol_type = other DNA
accatcaccctctgtgattttataa

SEQ ID NO: 1086 - DNA, 20 bp, synthetic construct
  misc_feature 1..20: note = Synthetic
  source 1..20: mol_type = other DNA
tcaccctctgtgattttata

SEQ ID NO: 1087 - DNA, 30 bp, synthetic construct
  misc_feature 1..30: note = Synthetic
  source 1..30: mol_type = other DNA
tcacccaccatcaccctctgtgattttata

SEQ ID NO: 1088 - DNA, 25 bp, synthetic construct
  misc_feature 1..25: note = Synthetic
  source 1..25: mol_type = other DNA
caccatcaccctctgtgattttata

SEQ ID NO: 1089 - DNA, 20 bp, synthetic construct
  misc_feature 1..20: note = Synthetic
  source 1..20: mol_type = other DNA
atcaccctctgtgattttat

SEQ ID NO: 1090 - DNA, 30 bp, synthetic construct
  misc_feature 1..30: note = Synthetic
  source 1..30: mol_type = other DNA
gtcacccaccatcaccctctgtgattttat

SEQ ID NO: 1091 - DNA, 40 bp, synthetic construct
  misc_feature 1..40: note = Synthetic
  source 1..40: mol_type = other DNA
tatcctcaaggtcacccaccatcaccctctgtgattttat

SEQ ID NO: 1092 - DNA, 19 bp, synthetic construct
  misc_feature 1..19: note = Synthetic
  source 1..19: mol_type = other DNA
tcaccctctgtgattttat

SEQ ID NO: 1093 - DNA, 25 bp, synthetic construct
  misc_feature 1..25: note = Synthetic
  source 1..25: mol_type = other DNA
ccaccatcaccctctgtgattttat

SEQ ID NO: 1094 - DNA, 20 bp, synthetic construct
  misc_feature 1..20: note = Synthetic
  source 1..20: mol_type = other DNA
catcaccctctgtgatttta

SEQ ID NO: 1095 - DNA, 30 bp, synthetic construct
  misc_feature 1..30: note = Synthetic
  source 1..30: mol_type = other DNA
ggtcacccaccatcaccctctgtgatttta

SEQ ID NO: 1096 - DNA, 25 bp, synthetic construct
  misc_feature 1..25: note = Synthetic
  source 1..25: mol_type = other DNA
cccaccatcaccctctgtgatttta

SEQ ID NO: 1097 - DNA, 20 bp, synthetic construct
  misc_feature 1..20: note = Synthetic
  source 1..20: mol_type = other DNA
ccatcaccctctgtgatttt

SEQ ID NO: 1098 - DNA, 30 bp, synthetic construct
  misc_feature 1..30: note = Synthetic
  source 1..30: mol_type = other DNA
aggtcacccaccatcaccctctgtgatttt

SEQ ID NO: 1099 - DNA, 25 bp, synthetic construct
  misc_feature 1..25: note = Synthetic
  source 1..25: mol_type = other DNA
acccaccatcaccctctgtgatttt

SEQ ID NO: 1100 - DNA, 20 bp, synthetic construct
  misc_feature 1..20: note = Synthetic
  source 1..20: mol_type = other DNA
accatcaccctctgtgattt

SEQ ID NO: 1101 - DNA, 30 bp, synthetic construct
  misc_feature 1..30: note = Synthetic
  source 1..30: mol_type = other DNA
aaggtcacccaccatcaccctctgtgattt

SEQ ID NO: 1102 - DNA, 21 bp, synthetic construct
  misc_feature 1..21: note = Synthetic
  source 1..21: mol_type = other DNA
caccatcaccctctgtgattt

SEQ ID NO: 1103 - DNA, 25 bp, synthetic construct
  misc_feature 1..25: note = Synthetic
  source 1..25: mol_type = other DNA
cacccaccatcaccctctgtgattt

SEQ ID NO: 1104 - DNA, 20 bp, synthetic construct
  misc_feature 1..20: note = Synthetic
  source 1..20: mol_type = other DNA
caccatcaccctctgtgatt

SEQ ID NO: 1105 - DNA, 30 bp, synthetic construct
  misc_feature 1..30: note = Synthetic
  source 1..30: mol_type = other DNA
caaggtcacccaccatcaccctctgtgatt

SEQ ID NO: 1106 - DNA, 25 bp, synthetic construct
  misc_feature 1..25: note = Synthetic
  source 1..25: mol_type = other DNA
tcacccaccatcaccctctgtgatt

SEQ ID NO: 1107 - DNA, 20 bp, synthetic construct
  misc_feature 1..20: note = Synthetic
  source 1..20: mol_type = other DNA
ccaccatcaccctctgtgat

SEQ ID NO: 1108 - DNA, 30 bp, synthetic construct
  misc_feature 1..30: note = Synthetic
  source 1..30: mol_type = other DNA
tcaaggtcacccaccatcaccctctgtgat

SEQ ID NO: 1109 - DNA, 25 bp, synthetic construct
  misc_feature 1..25: note = Synthetic
  source 1..25: mol_type = other DNA
gtcacccaccatcaccctctgtgat

SEQ ID NO: 1110 - DNA, 20 bp, synthetic construct
  misc_feature 1..20: note = Synthetic
  source 1..20: mol_type = other DNA
cccaccatcaccctctgtga

SEQ ID NO: 1111 - DNA, 30 bp, synthetic construct
  misc_feature 1..30: note = Synthetic
  source 1..30: mol_type = other DNA
ctcaaggtcacccaccatcaccctctgtga

SEQ ID NO: 1112 - DNA, 25 bp, synthetic construct
  misc_feature 1..25: note = Synthetic
  source 1..25: mol_type = other DNA
ggtcacccaccatcaccctctgtga

SEQ ID NO: 1113 - DNA, 20 bp, synthetic construct
  misc_feature 1..20: note = Synthetic
  source 1..20: mol_type = other DNA
acccaccatcaccctctgtg

SEQ ID NO: 1114 - DNA, 30 bp, synthetic construct
  misc_feature 1..30: note = Synthetic
  source 1..30: mol_type = other DNA
cctcaaggtcacccaccatcaccctctgtg

SEQ ID NO: 1115 - DNA, 21 bp, synthetic construct
  misc_feature 1..21: note = Synthetic
  source 1..21: mol_type = other DNA
cacccaccatcaccctctgtg

SEQ ID NO: 1116 - DNA, 25 bp, synthetic construct
  misc_feature 1..25: note = Synthetic
  source 1..25: mol_type = other DNA
aggtcacccaccatcaccctctgtg

SEQ ID NO: 1117 - DNA, 20 bp, synthetic construct
  misc_feature 1..20: note = Synthetic
  source 1..20: mol_type = other DNA
cacccaccatcaccctctgt

SEQ ID NO: 1118 - DNA, 30 bp, synthetic construct
  misc_feature 1..30: note = Synthetic
  source 1..30: mol_type = other DNA
tcctcaaggtcacccaccatcaccctctgt

SEQ ID NO: 1119 - DNA, 25 bp, synthetic construct
  misc_feature 1..25: note = Synthetic
  source 1..25: mol_type = other DNA
aaggtcacccaccatcaccctctgt

SEQ ID NO: 1120 - DNA, 33 bp, synthetic construct
  misc_feature 1..33: note = Synthetic
  source 1..33: mol_type = other DNA
atatcctcaaggtcacccaccatcaccctctgt

SEQ ID NO: 1121 - DNA, 26 bp, synthetic construct
  misc_feature 1..26: note = Synthetic
  source 1..26: mol_type = other DNA
caaggtcacccaccatcaccctctgt

SEQ ID NO: 1122 - DNA, 20 bp, synthetic construct
  misc_feature 1..20: note = Synthetic
  source 1..20: mol_type = other DNA
tcacccaccatcaccctctg

SEQ ID NO: 1123 - DNA, 30 bp, synthetic construct
  misc_feature 1..30: note = Synthetic
  source 1..30: mol_type = other DNA
atcctcaaggtcacccaccatcaccctctg

SEQ ID NO: 1124 - DNA, 25 bp, synthetic construct
  misc_feature 1..25: note = Synthetic
  source 1..25: mol_type = other DNA
caaggtcacccaccatcaccctctg

SEQ ID NO: 1125 - DNA, 30 bp, synthetic construct
  misc_feature 1..30: note = Synthetic
  source 1..30: mol_type = other DNA
tatcctcaaggtcacccaccatcaccctct

SEQ ID NO: 1126 - DNA, 30 bp, synthetic construct
  misc_feature 1..30: note = Synthetic
  source 1..30: mol_type = other DNA
atatcctcaaggtcacccaccatcaccctc

SEQ ID NO: 1127 - DNA, 30 bp, synthetic construct
  misc_feature 1..30: note = Synthetic
  source 1..30: mol_type = other DNA
gatatcctcaaggtcacccaccatcaccct

SEQ ID NO: 1128 - DNA, 25 bp, synthetic construct
  misc_feature 1..25: note = Synthetic
  source 1..25: mol_type = other DNA
cctcaaggtcacccaccatcaccct

SEQ ID NO: 1129 - DNA, 30 bp, synthetic construct
  misc_feature 1..30: note = Synthetic
  source 1..30: mol_type = other DNA
tgatatcctcaaggtcacccaccatcaccc

SEQ ID NO: 1130 - DNA, 25 bp, synthetic construct
  misc_feature 1..25: note = Synthetic
  source 1..25: mol_type = other DNA
tcctcaaggtcacccaccatcaccc

SEQ ID NO: 1131 - DNA, 30 bp, synthetic construct
  misc_feature 1..30: note = Synthetic
  source 1..30: mol_type = other DNA
ttgatatcctcaaggtcacccaccatcacc

SEQ ID NO: 1132 - DNA, 25 bp, synthetic construct
  misc_feature 1..25: note = Synthetic
  source 1..25: mol_type = other DNA
atcctcaaggtcacccaccatcacc

SEQ ID NO: 1133 - DNA, 30 bp, synthetic construct
  misc_feature 1..30: note = Synthetic
  source 1..30: mol_type = other DNA
gttgatatcctcaaggtcacccaccatcac

SEQ ID NO: 1134 - DNA, 25 bp, synthetic construct
  misc_feature 1..25: note = Synthetic
  source 1..25: mol_type = other DNA
tatcctcaaggtcacccaccatcac

SEQ ID NO: 1135 - DNA, 30 bp, synthetic construct
  misc_feature 1..30: note = Synthetic
  source 1..30: mol_type = other DNA
cgttgatatcctcaaggtcacccaccatca

SEQ ID NO: 1136 - DNA, 25 bp, synthetic construct
  misc_feature 1..25: note = Synthetic
  source 1..25: mol_type = other DNA
atatcctcaaggtcacccaccatca

SEQ ID NO: 1137 - DNA, 20 bp, synthetic construct
  misc_feature 1..20: note = Synthetic
  source 1..20: mol_type = other DNA
cctcaaggtcacccaccatc

SEQ ID NO: 1138 - DNA, 30 bp, synthetic construct
  misc_feature 1..30: note = Synthetic
  source 1..30: mol_type = other DNA
tcgttgatatcctcaaggtcacccaccatc

SEQ ID NO: 1139 - DNA, 25 bp, synthetic construct
  misc_feature 1..25: note = Synthetic
  source 1..25: mol_type = other DNA
gatatcctcaaggtcacccaccatc

SEQ ID NO: 1140 - DNA, 20 bp, synthetic construct
  misc_feature 1..20: note = Synthetic
  source 1..20: mol_type = other DNA
tcctcaaggtcacccaccat

SEQ ID NO: 1141 - DNA, 30 bp, synthetic construct
  misc_feature 1..30: note = Synthetic
  source 1..30: mol_type = other DNA
ctcgttgatatcctcaaggtcacccaccat

SEQ ID NO: 1142 - DNA, 25 bp, synthetic construct
  misc_feature 1..25: note = Synthetic
  source 1..25: mol_type = other DNA
tgatatcctcaaggtcacccaccat

SEQ ID NO: 1143 - DNA, 20 bp, synthetic construct
  misc_feature 1..20: note = Synthetic
  source 1..20: mol_type = other DNA
atcctcaaggtcacccacca

SEQ ID NO: 1144 - DNA, 30 bp, synthetic construct
  misc_feature 1..30: note = Synthetic
  source 1..30: mol_type = other DNA
tctcgttgatatcctcaaggtcacccacca

SEQ ID NO: 1145 - DNA, 25 bp, synthetic construct
  misc_feature 1..25: note = Synthetic
  source 1..25: mol_type = other DNA
ttgatatcctcaaggtcacccacca

SEQ ID NO: 1146 - DNA, 20 bp, synthetic construct
  misc_feature 1..20: note = Synthetic
  source 1..20: mol_type = other DNA
tatcctcaaggtcacccacc

SEQ ID NO: 1147 - DNA, 30 bp, synthetic construct
  misc_feature 1..30: note = Synthetic
  source 1..30: mol_type = other DNA
atctcgttgatatcctcaaggtcacccacc

SEQ ID NO: 1148 - DNA, 19 bp, synthetic construct
  misc_feature 1..19: note = Synthetic
  source 1..19: mol_type = other DNA
atcctcaaggtcacccacc

SEQ ID NO: 1149 - DNA, 23 bp, synthetic construct
  misc_feature 1..23: note = Synthetic
  source 1..23: mol_type = other DNA
tgatatcctcaaggtcacccacc

SEQ ID NO: 1150 - DNA, 25 bp, synthetic construct
  misc_feature 1..25: note = Synthetic
  source 1..25: mol_type = other DNA
gttgatatcctcaaggtcacccacc

SEQ ID NO: 1151 - DNA, 20 bp, synthetic construct
  misc_feature 1..20: note = Synthetic
  source 1..20: mol_type = other DNA
atatcctcaaggtcacccac

SEQ ID NO: 1152 - DNA, 30 bp, synthetic construct
  misc_feature 1..30: note = Synthetic
  source 1..30: mol_type = other DNA
catctcgttgatatcctcaaggtcacccac

SEQ ID NO: 1153 - DNA, 25 bp, synthetic construct
  misc_feature 1..25: note = Synthetic
  source 1..25: mol_type = other DNA
cgttgatatcctcaaggtcacccac

SEQ ID NO: 1154 - DNA, 20 bp, synthetic construct
  misc_feature 1..20: note = Synthetic
  source 1..20: mol_type = other DNA
gatatcctcaaggtcaccca

SEQ ID NO: 1155 - DNA, 30 bp, synthetic construct
  misc_feature 1..30: note = Synthetic
  source 1..30: mol_type = other DNA
tcatctcgttgatatcctcaaggtcaccca

SEQ ID NO: 1156 - DNA, 25 bp, synthetic construct
  misc_feature 1..25: note = Synthetic
  source 1..25: mol_type = other DNA
tcgttgatatcctcaaggtcaccca

SEQ ID NO: 1157 - DNA, 20 bp, synthetic construct
  misc_feature 1..20: note = Synthetic
  source 1..20: mol_type = other DNA
tgatatcctcaaggtcaccc

SEQ ID NO: 1158 - DNA, 30 bp, synthetic construct
  misc_feature 1..30: note = Synthetic
  source 1..30: mol_type = other DNA
atcatctcgttgatatcctcaaggtcaccc

SEQ ID NO: 1159 - DNA, 21 bp, synthetic construct
  misc_feature 1..21: note = Synthetic
  source 1..21: mol_type = other DNA
ttgatatcctcaaggtcaccc

SEQ ID NO: 1160 - DNA, 25 bp, synthetic construct
  misc_feature 1..25: note = Synthetic
  source 1..25: mol_type = other DNA
ctcgttgatatcctcaaggtcaccc

SEQ ID NO: 1161 - DNA, 20 bp, synthetic construct
  misc_feature 1..20: note = Synthetic
  source 1..20: mol_type = other DNA
ttgatatcctcaaggtcacc

SEQ ID NO: 1162 - DNA, 30 bp, synthetic construct
  misc_feature 1..30: note = Synthetic
  source 1..30: mol_type = other DNA
gatcatctcgttgatatcctcaaggtcacc

SEQ ID NO: 1163 - DNA, 19 bp, synthetic construct
  misc_feature 1..19: note = Synthetic
  source 1..19: mol_type = other DNA
tgatatcctcaaggtcacc

SEQ ID NO: 1164 - DNA, 26 bp, synthetic construct
  misc_feature 1..26: note = Synthetic
  source 1..26: mol_type = other DNA
atctcgttgatatcctcaaggtcacc

SEQ ID NO: 1165 - DNA, 25 bp, synthetic construct
  misc_feature 1..25: note = Synthetic
  source 1..25: mol_type = other DNA
tctcgttgatatcctcaaggtcacc

SEQ ID NO: 1166 - DNA, 20 bp, synthetic construct
  misc_feature 1..20: note = Synthetic
  source 1..20: mol_type = other DNA
gttgatatcctcaaggtcac

SEQ ID NO: 1167 - DNA, 30 bp, synthetic construct
  misc_feature 1..30: note = Synthetic
  source 1..30: mol_type = other DNA
tgatcatctcgttgatatcctcaaggtcac

SEQ ID NO: 1168 - DNA, 25 bp, synthetic construct
  misc_feature 1..25: note = Synthetic
  source 1..25: mol_type = other DNA
atctcgttgatatcctcaaggtcac

SEQ ID NO: 1169 - DNA, 20 bp, synthetic construct
  misc_feature 1..20: note = Synthetic
  source 1..20: mol_type = other DNA
cgttgatatcctcaaggtca

SEQ ID NO: 1170 - DNA, 30 bp, synthetic construct
  misc_feature 1..30: note = Synthetic
  source 1..30: mol_type = other DNA
atgatcatctcgttgatatcctcaaggtca

SEQ ID NO: 1171 - DNA, 34 bp, synthetic construct
  misc_feature 1..34: note = Synthetic
  source 1..34: mol_type = other DNA
cttgatgatcatctcgttgatatcctcaaggtca

SEQ ID NO: 1172 - DNA, 37 bp, synthetic construct
  misc_feature 1..37: note = Synthetic
  source 1..37: mol_type = other DNA
ctgcttgatgatcatctcgttgatatcctcaaggtca

SEQ ID NO: 1173 - DNA, 25 bp, synthetic construct
  misc_feature 1..25: note = Synthetic
  source 1..25: mol_type = other DNA
catctcgttgatatcctcaaggtca

SEQ ID NO: 1174 - DNA, 20 bp, synthetic construct
  misc_feature 1..20: note = Synthetic
  source 1..20: mol_type = other DNA
tcgttgatatcctcaaggtc

SEQ ID NO: 1175 - DNA, 30 bp, synthetic construct
  misc_feature 1..30: note = Synthetic
  source 1..30: mol_type = other DNA
gatgatcatctcgttgatatcctcaaggtc

SEQ ID NO: 1176 - DNA, 25 bp, synthetic construct
  misc_feature 1..25: note = Synthetic
  source 1..25: mol_type = other DNA
tcatctcgttgatatcctcaaggtc

SEQ ID NO: 1177 - DNA, 20 bp, synthetic construct
  misc_feature 1..20: note = Synthetic
  source 1..20: mol_type = other DNA
ctcgttgatatcctcaaggt

SEQ ID NO: 1178 - DNA, 30 bp, synthetic construct
  misc_feature 1..30: note = Synthetic
  source 1..30: mol_type = other DNA
tgatgatcatctcgttgatatcctcaaggt

SEQ ID NO: 1179 - DNA, 25 bp, synthetic construct
  misc_feature 1..25: note = Synthetic
  source 1..25: mol_type = other DNA
atcatctcgttgatatcctcaaggt

SEQ ID NO: 1180 - DNA, 20 bp, synthetic construct
  misc_feature 1..20: note = Synthetic
  source 1..20: mol_type = other DNA
tctcgttgatatcctcaagg

SEQ ID NO: 1181 - DNA, 30 bp, synthetic construct
  misc_feature 1..30: note = Synthetic
  source 1..30: mol_type = other DNA
ttgatgatcatctcgttgatatcctcaagg

SEQ ID NO: 1182 - DNA, 25 bp, synthetic construct
  misc_feature 1..25: note = Synthetic
  source 1..25: mol_type = other DNA
gatcatctcgttgatatcctcaagg

SEQ ID NO: 1183 - DNA, 20 bp, synthetic construct
  misc_feature 1..20: note = Synthetic
  source 1..20: mol_type = other DNA
atctcgttgatatcctcaag

SEQ ID NO: 1184 - DNA, 30 bp, synthetic construct
  misc_feature 1..30: note = Synthetic
  source 1..30: mol_type = other DNA
cttgatgatcatctcgttgatatcctcaag

SEQ ID NO: 1185 - DNA, 25 bp, synthetic construct
  misc_feature 1..25: note = Synthetic
  source 1..25: mol_type = other DNA
tgatcatctcgttgatatcctcaag

SEQ ID NO: 1186 - DNA, 20 bp, synthetic construct
  misc_feature 1..20: note = Synthetic
  source 1..20: mol_type = other DNA
catctcgttgatatcctcaa

SEQ ID NO: 1187 - DNA, 30 bp, synthetic construct
  misc_feature 1..30: note = Synthetic
  source 1..30: mol_type = other DNA
gcttgatgatcatctcgttgatatcctcaa

SEQ ID NO: 1188 - DNA, 33 bp, synthetic construct
  misc_feature 1..33: note = Synthetic
  source 1..33: mol_type = other DNA
tctgcttgatgatcatctcgttgatatcctcaa

SEQ ID NO: 1189 - DNA, 22 bp, synthetic construct
  misc_feature 1..22: note = Synthetic
  source 1..22: mol_type = other DNA
atcatctcgttgatatcctcaa

SEQ ID NO: 1190 - DNA, 25 bp, synthetic construct
  misc_feature 1..25: note = Synthetic
  source 1..25: mol_type = other DNA
atgatcatctcgttgatatcctcaa

SEQ ID NO: 1191 - DNA, 20 bp, synthetic construct
  misc_feature 1..20: note = Synthetic
  source 1..20: mol_type = other DNA
tcatctcgttgatatcctca

SEQ ID NO: 1192 - DNA, 30 bp, synthetic construct
  misc_feature 1..30: note = Synthetic
  source 1..30: mol_type = other DNA
tgcttgatgatcatctcgttgatatcctca

SEQ ID NO: 1193 - DNA, 25 bp, synthetic construct
  misc_feature 1..25: note = Synthetic
  source 1..25: mol_type = other DNA
gatgatcatctcgttgatatcctca

SEQ ID NO: 1194 - DNA, 20 bp, synthetic construct
  misc_feature 1..20: note = Synthetic
  source 1..20: mol_type = other DNA
atcatctcgttgatatcctc

SEQ ID NO: 1195 - DNA, 30 bp, synthetic construct
  misc_feature 1..30: note = Synthetic
  source 1..30: mol_type = other DNA
ctgcttgatgatcatctcgttgatatcctc

SEQ ID NO: 1196 - DNA, 21 bp, synthetic construct
  misc_feature 1..21: note = Synthetic
  source 1..21: mol_type = other DNA
gatcatctcgttgatatcctc

SEQ ID NO: 1197 - DNA, 25 bp, synthetic construct
  misc_feature 1..25: note = Synthetic
  source 1..25: mol_type = other DNA
tgatgatcatctcgttgatatcctc

SEQ ID NO: 1198 - DNA, 20 bp, synthetic construct
  misc_feature 1..20: note = Synthetic
  source 1..20: mol_type = other DNA
gatcatctcgttgatatcct

SEQ ID NO: 1199 - DNA, 30 bp, synthetic construct
  misc_feature 1..30: note = Synthetic
  source 1..30: mol_type = other DNA
tctgcttgatgatcatctcgttgatatcct

SEQ ID NO: 1200 - DNA, 25 bp, synthetic construct
  misc_feature 1..25: note = Synthetic
  source 1..25: mol_type = other DNA
ttgatgatcatctcgttgatatcct

SEQ ID NO: 1201 - DNA, 20 bp, synthetic construct
  misc_feature 1..20: note = Synthetic
  source 1..20: mol_type = other DNA
tgatcatctcgttgatatcc

SEQ ID NO: 1202 - DNA, 30 bp, synthetic construct
  misc_feature 1..30: note = Synthetic
  source 1..30: mol_type = other DNA
ttctgcttgatgatcatctcgttgatatcc

SEQ ID NO: 1203 - DNA, 25 bp, synthetic construct
  misc_feature 1..25: note = Synthetic
  source 1..25: mol_type = other DNA
cttgatgatcatctcgttgatatcc

SEQ ID NO: 1204 - DNA, 20 bp, synthetic construct
  misc_feature 1..20: note = Synthetic
  source 1..20: mol_type = other DNA
atgatcatctcgttgatatc

SEQ ID NO: 1205 - DNA, 30 bp, synthetic construct
  misc_feature 1..30: note = Synthetic
  source 1..30: mol_type = other DNA
cttctgcttgatgatcatctcgttgatatc

SEQ ID NO: 1206 - DNA, 25 bp, synthetic construct
  misc_feature 1..25: note = Synthetic
  source 1..25: mol_type = other DNA
gcttgatgatcatctcgttgatatc

SEQ ID NO: 1207 - DNA, 20 bp, synthetic construct
  misc_feature 1..20: note = Synthetic
  source 1..20: mol_type = other DNA
gatgatcatctcgttgatat

SEQ ID NO: 1208 - DNA, 30 bp, synthetic construct
  misc_feature 1..30: note = Synthetic
  source 1..30: mol_type = other DNA
ccttctgcttgatgatcatctcgttgatat

SEQ ID NO: 1209 - DNA, 27 bp, synthetic construct
  misc_feature 1..27: note = Synthetic
  source 1..27: mol_type = other DNA
tctgcttgatgatcatctcgttgatat

SEQ ID NO: 1210 - DNA, 29 bp, synthetic construct
  misc_feature 1..29: note = Synthetic
  source 1..29: mol_type = other DNA
cttctgcttgatgatcatctcgttgatat

SEQ ID NO: 1211 - DNA, 25 bp, synthetic construct
  misc_feature 1..25: note = Synthetic
  source 1..25: mol_type = other DNA
tgcttgatgatcatctcgttgatat

SEQ ID NO: 1212 - DNA, 20 bp, synthetic construct
  misc_feature 1..20: note = Synthetic
  source 1..20: mol_type = other DNA
tgatgatcatctcgttgata

SEQ ID NO: 1213 - DNA, 30 bp, synthetic construct
  misc_feature 1..30: note = Synthetic
  source 1..30: mol_type = other DNA
accttctgcttgatgatcatctcgttgata

SEQ ID NO: 1214 - DNA, 25 bp, synthetic construct
  misc_feature 1..25: note = Synthetic
  source 1..25: mol_type = other DNA
ctgcttgatgatcatctcgttgata

SEQ ID NO: 1215 - DNA, 20 bp, synthetic construct
  misc_feature 1..20: note = Synthetic
  source 1..20: mol_type = other DNA
ttgatgatcatctcgttgat

SEQ ID NO: 1216 - DNA, 30 bp, synthetic construct
  misc_feature 1..30: note = Synthetic
  source 1..30: mol_type = other DNA
taccttctgcttgatgatcatctcgttgat

SEQ ID NO: 1217 - DNA, 25 bp, synthetic construct
  misc_feature 1..25: note = Synthetic
  source 1..25: mol_type = other DNA
tctgcttgatgatcatctcgttgat

SEQ ID NO: 1218 - DNA, 20 bp, synthetic construct
  misc_feature 1..20: note = Synthetic
  source 1..20: mol_type = other DNA
cttgatgatcatctcgttga

SEQ ID NO: 1219 - DNA, 30 bp, synthetic construct
  misc_feature 1..30: note = Synthetic
  source 1..30: mol_type = other DNA
ataccttctgcttgatgatcatctcgttga

SEQ ID NO: 1220 - DNA, 26 bp, synthetic construct
  misc_feature 1..26: note = Synthetic
  source 1..26: mol_type = other DNA
cttctgcttgatgatcatctcgttga

SEQ ID NO: 1221 - DNA, 25 bp, synthetic construct
  misc_feature 1..25: note = Synthetic
  source 1..25: mol_type = other DNA
ttctgcttgatgatcatctcgttga

SEQ ID NO: 1222 - DNA, 20 bp, synthetic construct
  misc_feature 1..20: note = Synthetic
  source 1..20: mol_type = other DNA
gcttgatgatcatctcgttg

SEQ ID NO: 1223 - DNA, 30 bp, synthetic construct
  misc_feature 1..30: note = Synthetic
  source 1..30: mol_type = other DNA
cataccttctgcttgatgatcatctcgttg

SEQ ID NO: 1224 - DNA, 22 bp, synthetic construct
  misc_feature 1..22: note = Synthetic
  source 1..22: mol_type = other DNA
ctgcttgatgatcatctcgttg

SEQ ID NO: 1225 - DNA, 26 bp, synthetic construct
  misc_feature 1..26: note = Synthetic
  source 1..26: mol_type = other DNA
ccttctgcttgatgatcatctcgttg

SEQ ID NO: 1226 - DNA, 25 bp, synthetic construct
  misc_feature 1..25: note = Synthetic
  source 1..25: mol_type = other DNA
cttctgcttgatgatcatctcgttg

SEQ ID NO: 1227 - DNA, 20 bp, synthetic construct
  misc_feature 1..20: note = Synthetic
  source 1..20: mol_type = other DNA
tgcttgatgatcatctcgtt

SEQ ID NO: 1228 - DNA, 30 bp, synthetic construct
  misc_feature 1..30: note = Synthetic
  source 1..30: mol_type = other DNA
tcataccttctgcttgatgatcatctcgtt

SEQ ID NO: 1229 - DNA, 21 bp, synthetic construct
  misc_feature 1..21: note = Synthetic
  source 1..21: mol_type = other DNA
ctgcttgatgatcatctcgtt

SEQ ID NO: 1230 - DNA, 20 bp, synthetic construct
  misc_feature 1..20: note = Synthetic
  source 1..20: mol_type = other DNA
ctgcttgatgatcatctcgt

SEQ ID NO: 1231 - DNA, 30 bp, synthetic construct
  misc_feature 1..30: note = Synthetic
  source 1..30: mol_type = other DNA
ctcataccttctgcttgatgatcatctcgt

SEQ ID NO: 1232 - DNA, 21 bp, synthetic construct
  misc_feature 1..21: note = Synthetic
  source 1..21: mol_type = other DNA
tctgcttgatgatcatctcgt

SEQ ID NO: 1233 - DNA, 25 bp, synthetic construct
  misc_feature 1..25: note = Synthetic
  source 1..25: mol_type = other DNA
accttctgcttgatgatcatctcgt

SEQ ID NO: 1234 - DNA, 20 bp, synthetic construct
  misc_feature 1..20: note = Synthetic
  source 1..20: mol_type = other DNA
tctgcttgatgatcatctcg

SEQ ID NO: 1235 - DNA, 30 bp, synthetic construct
  misc_feature 1..30: note = Synthetic
  source 1..30: mol_type = other DNA
tctcataccttctgcttgatgatcatctcg

SEQ ID NO: 1236 - DNA, 20 bp, synthetic construct
  misc_feature 1..20: note = Synthetic
  source 1..20: mol_type = other DNA
ttctgcttgatgatcatctc

SEQ ID NO: 1237 - DNA, 30 bp, synthetic construct
  misc_feature 1..30: note = Synthetic
  source 1..30: mol_type = other DNA
ttctcataccttctgcttgatgatcatctc

SEQ ID NO: 1238 - DNA, 21 bp, synthetic construct
  misc_feature 1..21: note = Synthetic
  source 1..21: mol_type = other DNA
cttctgcttgatgatcatctc

SEQ ID NO: 1239 - DNA, 18 bp, synthetic construct
  misc_feature 1..18: note = Synthetic
  source 1..18: mol_type = other DNA
ctgcttgatgatcatctc

SEQ ID NO: 1240 - DNA, 19 bp, synthetic construct
  misc_feature 1..19: note = Synthetic
  source 1..19: mol_type = other DNA
tctgcttgatgatcatctc

SEQ ID NO: 1241 - DNA, 29 bp, synthetic construct
  misc_feature 1..29: note = Synthetic
  source 1..29: mol_type = other DNA
tctcataccttctgcttgatgatcatctc

SEQ ID NO: 1242 - DNA, 30 bp, synthetic construct
  misc_feature 1..30: note = Synthetic
  source 1..30: mol_type = other DNA
aaaaacccaaaatattttagctcctactca

SEQ ID NO: 1243 - DNA, 40 bp, synthetic construct
  misc_feature 1..40: note = Synthetic
  source 1..40: mol_type = other DNA
aaaaacccaaaatattttagctcctactcagactgttact

SEQ ID NO: 1244 - DNA, 30 bp, synthetic construct
  misc_feature 1..30: note = Synthetic
  source 1..30: mol_type = other DNA
aaaacccaaaatattttagctcctactcag

SEQ ID NO: 1245 - DNA, 30 bp, synthetic construct
  misc_feature 1..30: note = Synthetic
  source 1..30: mol_type = other DNA
aaacccaaaatattttagctcctactcaga

SEQ ID NO: 1246 - DNA, 30 bp, synthetic construct
  misc_feature 1..30: note = Synthetic
  source 1..30: mol_type = other DNA
aacccaaaatattttagctcctactcagac

SEQ ID NO: 1247 - DNA, 30 bp, synthetic construct
  misc_feature 1..30: note = Synthetic
  source 1..30: mol_type = other DNA
acccaaaatattttagctcctactcagact

SEQ ID NO: 1248 - DNA, 30 bp, synthetic construct
  misc_feature 1..30: note = Synthetic
  source 1..30: mol_type = other DNA
cccaaaatattttagctcctactcagactg

SEQ ID NO: 1249 - DNA, 25 bp, synthetic construct
  misc_feature 1..25: note = Synthetic
  source 1..25: mol_type = other DNA
cccaaaatattttagctcctactca

SEQ ID NO: 1250 - DNA, 28 bp, synthetic construct
  misc_feature 1..28: note = Synthetic
  source 1..28: mol_type = other DNA
cccaaaatattttagctcctactcagac

SEQ ID NO: 1251 - DNA, 26 bp, synthetic construct
  misc_feature 1..26: note = Synthetic
  source 1..26: mol_type = other DNA
cccaaaatattttagctcctactcag

SEQ ID NO: 1252 - DNA, 30 bp, synthetic construct
  misc_feature 1..30: note = Synthetic
  source 1..30: mol_type = other DNA
ccaaaatattttagctcctactcagactgt

SEQ ID NO: 1253 - DNA, 24 bp, synthetic construct
  misc_feature 1..24: note = Synthetic
  source 1..24: mol_type = other DNA
ccaaaatattttagctcctactca

SEQ ID NO: 1254 - DNA, 30 bp, synthetic construct
  misc_feature 1..30: note = Synthetic
  source 1..30: mol_type = other DNA
caaaatattttagctcctactcagactgtt

SEQ ID NO: 1255 - DNA, 30 bp, synthetic construct
  misc_feature 1..30: note = Synthetic
  source 1..30: mol_type = other DNA
aaaatattttagctcctactcagactgtta

SEQ ID NO: 1256 - DNA, 44 bp, synthetic construct
  misc_feature 1..44: note = Synthetic
  source 1..44: mol_type = other DNA
aaaatattttagctcctactcagactgttactctggtgacacaa

SEQ ID NO: 1257 - DNA, 23 bp, synthetic construct
  misc_feature 1..23: note = Synthetic
  source 1..23: mol_type = other DNA
aaaatattttagctcctactcag

SEQ ID NO: 1258 - DNA, 30 bp, synthetic construct
  misc_feature 1..30: note = Synthetic
  source 1..30: mol_type = other DNA
aaatattttagctcctactcagactgttac

SEQ ID NO: 1259 - DNA, 40 bp, synthetic construct
  misc_feature 1..40: note = Synthetic
  source 1..40: mol_type = other DNA
aaatattttagctcctactcagactgttactctggtgaca

SEQ ID NO: 1260 - DNA, 20 bp, synthetic construct
  misc_feature 1..20: note = Synthetic
  source 1..20: mol_type = other DNA
aatattttagctcctactca

SEQ ID NO: 1261 - DNA, 30 bp, synthetic construct
  misc_feature 1..30: note = Synthetic
  source 1..30: mol_type = other DNA
aatattttagctcctactcagactgttact

SEQ ID NO: 1262 - DNA, 26 bp, synthetic construct
  misc_feature 1..26: note = Synthetic
  source 1..26: mol_type = other DNA
aatattttagctcctactcagactgt

SEQ ID NO: 1263 - DNA, 25 bp, synthetic construct
  misc_feature 1..25: note = Synthetic
  source 1..25: mol_type = other DNA
aatattttagctcctactcagactg

SEQ ID NO: 1264 - DNA, 21 bp, synthetic construct
  misc_feature 1..21: note = Synthetic
  source 1..21: mol_type = other DNA
aatattttagctcctactcag

SEQ ID NO: 1265 - DNA, 20 bp, synthetic construct
  misc_feature 1..20: note = Synthetic
  source 1..20: mol_type = other DNA
atattttagctcctactcag

SEQ ID NO: 1266 - DNA, 30 bp, synthetic construct
  misc_feature 1..30: note = Synthetic
  source 1..30: mol_type = other DNA
atattttagctcctactcagactgttactc

SEQ ID NO: 1267 - DNA, 21 bp, synthetic construct
  misc_feature 1..21: note = Synthetic
  source 1..21: mol_type = other DNA
atattttagctcctactcaga

SEQ ID NO: 1268 - DNA, 20 bp, synthetic construct
  misc_feature 1..20: note = Synthetic
  source 1..20: mol_type = other DNA
tattttagctcctactcaga

SEQ ID NO: 1269 - DNA, 30 bp, synthetic construct
  misc_feature 1..30: note = Synthetic
  source 1..30: mol_type = other DNA
tattttagctcctactcagactgttactct

SEQ ID NO: 1270 - DNA, 35 bp, synthetic construct
  misc_feature 1..35: note = Synthetic
  source 1..35: mol_type = other DNA
tattttagctcctactcagactgttactctggtga

SEQ ID NO: 1271 - DNA, 20 bp, synthetic construct
  misc_feature 1..20: note = Synthetic
  source 1..20: mol_type = other DNA
attttagctcctactcagac

SEQ ID NO: 1272 - DNA, 30 bp, synthetic construct
  misc_feature 1..30: note = Synthetic
  source 1..30: mol_type = other DNA
attttagctcctactcagactgttactctg

SEQ ID NO: 1273 - DNA, 20 bp, synthetic construct
  misc_feature 1..20: note = Synthetic
  source 1..20: mol_type = other DNA
ttttagctcctactcagact

SEQ ID NO: 1274 - DNA, 30 bp, synthetic construct
  misc_feature 1..30: note = Synthetic
  source 1..30: mol_type = other DNA
ttttagctcctactcagactgttactctgg

SEQ ID NO: 1275 - DNA, 23 bp, synthetic construct
  misc_feature 1..23: note = Synthetic
  source 1..23: mol_type = other DNA
ttttagctcctactcagactgtt

SEQ ID NO: 1276 - DNA, 44 bp, synthetic construct
  misc_feature 1..44: note = Synthetic
  source 1..44: mol_type = other DNA
ttttagctcctactcagactgttactctggtgacacaacctgtg

SEQ ID NO: 1277 - DNA, 20 bp, synthetic construct
  misc_feature 1..20: note = Synthetic
  source 1..20: mol_type = other DNA
tttagctcctactcagactg

SEQ ID NO: 1278 - DNA, 30 bp, synthetic construct
  misc_feature 1..30: note = Synthetic
  source 1..30: mol_type = other DNA
tttagctcctactcagactgttactctggt

SEQ ID NO: 1279 - DNA, 26 bp, synthetic construct
  misc_feature 1..26: note = Synthetic
  source 1..26: mol_type = other DNA
tttagctcctactcagactgttactc

SEQ ID NO: 1280 - DNA, 25 bp, synthetic construct
  misc_feature 1..25: note = Synthetic
  source 1..25: mol_type = other DNA
tttagctcctactcagactgttact

SEQ ID NO: 1281 - DNA, 20 bp, synthetic construct
  misc_feature 1..20: note = Synthetic
  source 1..20: mol_type = other DNA
ttagctcctactcagactgt

SEQ ID NO: 1282 - DNA, 30 bp, synthetic construct
  misc_feature 1..30: note = Synthetic
  source 1..30: mol_type = other DNA
ttagctcctactcagactgttactctggtg

SEQ ID NO: 1283 - DNA, 20 bp, synthetic construct
  misc_feature 1..20: note = Synthetic
  source 1..20: mol_type = other DNA
tagctcctactcagactgtt

SEQ ID NO: 1284 - DNA, 30 bp, synthetic construct
  misc_feature 1..30: note = Synthetic
  source 1..30: mol_type = other DNA
tagctcctactcagactgttactctggtga

SEQ ID NO: 1285 - DNA, 36 bp, synthetic construct
  misc_feature 1..36: note = Synthetic
  source 1..36: mol_type = other DNA
tagctcctactcagactgttactctggtgacacaac

SEQ ID NO: 1286 - DNA, 20 bp, synthetic construct
  misc_feature 1..20: note = Synthetic
  source 1..20: mol_type = other DNA
agctcctactcagactgtta

SEQ ID NO: 1287 - DNA, 30 bp, synthetic construct
  misc_feature 1..30: note = Synthetic
  source 1..30: mol_type = other DNA
agctcctactcagactgttactctggtgac

SEQ ID NO: 1288 - DNA, 24 bp, synthetic construct
  misc_feature 1..24: note = Synthetic
  source 1..24: mol_type = other DNA
agctcctactcagactgttactct

SEQ ID NO: 1289 - DNA, 25 bp, synthetic construct
  misc_feature 1..25: note = Synthetic
  source 1..25: mol_type = other DNA
agctcctactcagactgttactctg

SEQ ID NO: 1290 - DNA, 20 bp, synthetic construct
  misc_feature 1..20: note = Synthetic
  source 1..20: mol_type = other DNA
gctcctactcagactgttac

SEQ ID NO: 1291 - DNA, 30 bp, synthetic construct
  misc_feature 1..30: note = Synthetic
  source 1..30: mol_type = other DNA
gctcctactcagactgttactctggtgaca

SEQ ID NO: 1292 - DNA, 24 bp, synthetic construct
  misc_feature 1..24: note = Synthetic
  source 1..24: mol_type = other DNA
gctcctactcagactgttactctg

SEQ ID NO: 1293 - DNA, 26 bp, synthetic construct
  misc_feature 1..26: note = Synthetic
  source 1..26: mol_type = other DNA
gctcctactcagactgttactctggt

SEQ ID NO: 1294 - DNA, 25 bp, synthetic construct
  misc_feature 1..25: note = Synthetic
  source 1..25: mol_type = other DNA
gctcctactcagactgttactctgg

SEQ ID NO: 1295 - DNA, 20 bp, synthetic construct
  misc_feature 1..20: note = Synthetic
  source 1..20: mol_type = other DNA
ctcctactcagactgttact

SEQ ID NO: 1296 - DNA, 30 bp, synthetic construct
  misc_feature 1..30: note = Synthetic
  source 1..30: mol_type = other DNA
ctcctactcagactgttactctggtgacac

SEQ ID NO: 1297 - DNA, 25 bp, synthetic construct
  misc_feature 1..25: note = Synthetic
  source 1..25: mol_type = other DNA
ctcctactcagactgttactctggt

SEQ ID NO: 1298 - DNA, 18 bp, synthetic construct
  misc_feature 1..18: note = Synthetic
  source 1..18: mol_type = other DNA
ctcctactcagactgtta

SEQ ID NO: 1299 - DNA, 21 bp, synthetic construct
  misc_feature 1..21: note = Synthetic
  source 1..21: mol_type = other DNA
ctcctactcagactgttactc

SEQ ID NO: 1300 - DNA, 31 bp, synthetic construct
  misc_feature 1..31: note = Synthetic
  source 1..31: mol_type = other DNA
ctcctactcagactgttactctggtgacaca

SEQ ID NO: 1301 - DNA, 26 bp, synthetic construct
  misc_feature 1..26: note = Synthetic
  source 1..26: mol_type = other DNA
ctcctactcagactgttactctggtg

SEQ ID NO: 1302 - DNA, 29 bp, synthetic construct
  misc_feature 1..29: note = Synthetic
  source 1..29: mol_type = other DNA
ctcctactcagactgttactctggtgaca

SEQ ID NO: 1303 - DNA, 28 bp, synthetic construct
  misc_feature 1..28: note = Synthetic
  source 1..28: mol_type = other DNA
ctcctactcagactgttactctggtgac

SEQ ID NO: 1304 - DNA, 27 bp, synthetic construct
  misc_feature 1..27: note = Synthetic
  source 1..27: mol_type = other DNA
ctcctactcagactgttactctggtga

SEQ ID NO: 1305 - DNA, 23 bp, synthetic construct
  misc_feature 1..23: note = Synthetic
  source 1..23: mol_type = other DNA
ctcctactcagactgttactctg

SEQ ID NO: 1306 - DNA, 20 bp, synthetic construct
  misc_feature 1..20: note = Synthetic
  source 1..20: mol_type = other DNA
tcctactcagactgttactc

SEQ ID NO: 1307 - DNA, 30 bp, synthetic construct
  misc_feature 1..30: note = Synthetic
  source 1..30: mol_type = other DNA
tcctactcagactgttactctggtgacaca

SEQ ID NO: 1308 - DNA, 25 bp, synthetic construct
  misc_feature 1..25: note = Synthetic
  source 1..25: mol_type = other DNA
tcctactcagactgttactctggtg

SEQ ID NO: 1309 - DNA, 23 bp, synthetic construct
  misc_feature 1..23: note = Synthetic
  source 1..23: mol_type = other DNA
tcctactcagactgttactctgg

SEQ ID NO: 1310 - DNA, 20 bp, synthetic construct
  misc_feature 1..20: note = Synthetic
  source 1..20: mol_type = other DNA
cctactcagactgttactct

SEQ ID NO: 1311 - DNA, 30 bp, synthetic construct
  misc_feature 1..30: note = Synthetic
  source 1..30: mol_type = other DNA
cctactcagactgttactctggtgacacaa

SEQ ID NO: 1312 - DNA, 25 bp, synthetic construct
  misc_feature 1..25: note = Synthetic
  source 1..25: mol_type = other DNA
cctactcagactgttactctggtga

SEQ ID NO: 1313 - DNA, 19 bp, synthetic construct
  misc_feature 1..19: note = Synthetic
  source 1..19: mol_type = other DNA
cctactcagactgttactc

SEQ ID NO: 1314 - DNA, 20 bp, synthetic construct
  misc_feature 1..20: note = Synthetic
  source 1..20: mol_type = other DNA
ctactcagactgttactctg

SEQ ID NO: 1315 - DNA, 30 bp, synthetic construct
  misc_feature 1..30: note = Synthetic
  source 1..30: mol_type = other DNA
ctactcagactgttactctggtgacacaac

SEQ ID NO: 1316 - DNA, 25 bp, synthetic construct
  misc_feature 1..25: note = Synthetic
  source 1..25: mol_type = other DNA
ctactcagactgttactctggtgac

SEQ ID NO: 1317 - DNA, 26 bp, synthetic construct
  misc_feature 1..26: note = Synthetic
  source 1..26: mol_type = other DNA
ctactcagactgttactctggtgaca

SEQ ID NO: 1318 - DNA, 19 bp, synthetic construct
  misc_feature 1..19: note = Synthetic
  source 1..19: mol_type = other DNA
ctactcagactgttactct

SEQ ID NO: 1319 - DNA, 20 bp, synthetic construct
  misc_feature 1..20: note = Synthetic
  source 1..20: mol_type = other DNA
tactcagactgttactctgg

SEQ ID NO: 1320 - DNA, 30 bp, synthetic construct
  misc_feature 1..30: note = Synthetic
  source 1..30: mol_type = other DNA
tactcagactgttactctggtgacacaacc

SEQ ID NO: 1321 - DNA, 25 bp, synthetic construct
  misc_feature 1..25: note = Synthetic
  source 1..25: mol_type = other DNA
tactcagactgttactctggtgaca

SEQ ID NO: 1322 - DNA, 20 bp, synthetic construct
  misc_feature 1..20: note = Synthetic
  source 1..20: mol_type = other DNA
actcagactgttactctggt

SEQ ID NO: 1323 - DNA, 30 bp, synthetic construct
  misc_feature 1..30: note = Synthetic
  source 1..30: mol_type = other DNA
actcagactgttactctggtgacacaacct

SEQ ID NO: 1324 - DNA, 25 bp, synthetic construct
  misc_feature 1..25: note = Synthetic
  source 1..25: mol_type = other DNA
actcagactgttactctggtgacac

SEQ ID NO: 1325 - DNA, 20 bp, synthetic construct
  misc_feature 1..20: note = Synthetic
  source 1..20: mol_type = other DNA
ctcagactgttactctggtg

SEQ ID NO: 1326 - DNA, 30 bp, synthetic construct
  misc_feature 1..30: note = Synthetic
  source 1..30: mol_type = other DNA
ctcagactgttactctggtgacacaacctg

SEQ ID NO: 1327 - DNA, 25 bp, synthetic construct
  misc_feature 1..25: note = Synthetic
  source 1..25: mol_type = other DNA
ctcagactgttactctggtgacaca

SEQ ID NO: 1328 - DNA, 32 bp, synthetic construct
  misc_feature 1..32: note = Synthetic
  source 1..32: mol_type = other DNA
ctcagactgttactctggtgacacaacctgtg

SEQ ID NO: 1329 - DNA, 20 bp, synthetic construct
  misc_feature 1..20: note = Synthetic
  source 1..20: mol_type = other DNA
tcagactgttactctggtga

SEQ ID NO: 1330 - DNA, 30 bp, synthetic construct
  misc_feature 1..30: note = Synthetic
  source 1..30: mol_type = other DNA
tcagactgttactctggtgacacaacctgt

SEQ ID NO: 1331 - DNA, 25 bp, synthetic construct
  misc_feature 1..25: note = Synthetic
  source 1..25: mol_type = other DNA
tcagactgttactctggtgacacaa

SEQ ID NO: 1332 - DNA, 20 bp, synthetic construct
  misc_feature 1..20: note = Synthetic
  source 1..20: mol_type = other DNA
cagactgttactctggtgac

SEQ ID NO: 1333 - DNA, 30 bp, synthetic construct
  misc_feature 1..30: note = Synthetic
  source 1..30: mol_type = other DNA
cagactgttactctggtgacacaacctgtg

SEQ ID NO: 1334 - DNA, 25 bp, synthetic construct
  misc_feature 1..25: note = Synthetic
  source 1..25: mol_type = other DNA
cagactgttactctggtgacacaac

SEQ ID NO: 1335 - DNA, 20 bp, synthetic construct
  misc_feature 1..20: note = Synthetic
  source 1..20: mol_type = other DNA
agactgttactctggtgaca

SEQ ID NO: 1336 - DNA, 30 bp, synthetic construct
  misc_feature 1..30: note = Synthetic
  source 1..30: mol_type = other DNA
agactgttactctggtgacacaacctgtgg

SEQ ID NO: 1337 - DNA, 25 bp, synthetic construct
  misc_feature 1..25: note = Synthetic
  source 1..25: mol_type = other DNA
agactgttactctggtgacacaacc

SEQ ID NO: 1338 - DNA, 19 bp, synthetic construct
  misc_feature 1..19: note = Synthetic
  source 1..19: mol_type = other DNA
agactgttactctggtgac

SEQ ID NO: 1339 - DNA, 34 bp, synthetic construct
  misc_feature 1..34: note = Synthetic
  source 1..34: mol_type = other DNA
agactgttactctggtgacacaacctgtggttac

SEQ ID NO: 1340 - DNA, 23 bp, synthetic construct
  misc_feature 1..23: note = Synthetic
  source 1..23: mol_type = other DNA
agactgttactctggtgacacaa

SEQ ID NO: 1341 - DNA, 20 bp, synthetic construct
  misc_feature 1..20: note = Synthetic
  source 1..20: mol_type = other DNA
gactgttactctggtgacac

SEQ ID NO: 1342 - DNA, 30 bp, synthetic construct
  misc_feature 1..30: note = Synthetic
  source 1..30: mol_type = other DNA
gactgttactctggtgacacaacctgtggt

SEQ ID NO: 1343 - DNA, 25 bp, synthetic construct
  misc_feature 1..25: note = Synthetic
  source 1..25: mol_type = other DNA
gactgttactctggtgacacaacct

SEQ ID NO: 1344 - DNA, 21 bp, synthetic construct
  misc_feature 1..21: note = Synthetic
  source 1..21: mol_type = other DNA
gactgttactctggtgacaca

SEQ ID NO: 1345 - DNA, 20 bp, synthetic construct
  misc_feature 1..20: note = Synthetic
  source 1..20: mol_type = other DNA
actgttactctggtgacaca

SEQ ID NO: 1346 - DNA, 30 bp, synthetic construct
  misc_feature 1..30: note = Synthetic
  source 1..30: mol_type = other DNA
actgttactctggtgacacaacctgtggtt

SEQ ID NO: 1347 - DNA, 21 bp, synthetic construct
  misc_feature 1..21: note = Synthetic
  source 1..21: mol_type = other DNA
actgttactctggtgacacaa

SEQ ID NO: 1348 - DNA, 25 bp, synthetic construct
  misc_feature 1..25: note = Synthetic
  source 1..25: mol_type = other DNA
actgttactctggtgacacaacctg

SEQ ID NO: 1349 - DNA, 19 bp, synthetic construct
  misc_feature 1..19: note = Synthetic
  source 1..19: mol_type = other DNA
actgttactctggtgacac

SEQ ID NO: 1350 - DNA, 20 bp, synthetic construct
  misc_feature 1..20: note = Synthetic
  source 1..20: mol_type = other DNA
ctgttactctggtgacacaa

SEQ ID NO: 1351 - DNA, 30 bp, synthetic construct
  misc_feature 1..30: note = Synthetic
  source 1..30: mol_type = other DNA
ctgttactctggtgacacaacctgtggtta

SEQ ID NO: 1352 - DNA, 23 bp, synthetic construct
  misc_feature 1..23: note = Synthetic
  source 1..23: mol_type = other DNA
ctgttactctggtgacacaacct

SEQ ID NO: 1353 - DNA, 25 bp, synthetic construct
  misc_feature 1..25: note = Synthetic
  source 1..25: mol_type = other DNA
ctgttactctggtgacacaacctgt

SEQ ID NO: 1354 - DNA, 20 bp, synthetic construct
  misc_feature 1..20: note = Synthetic
  source 1..20: mol_type = other DNA
tgttactctggtgacacaac

SEQ ID NO: 1355 - DNA, 30 bp, synthetic construct
  misc_feature 1..30: note = Synthetic
  source 1..30: mol_type = other DNA
tgttactctggtgacacaacctgtggttac

SEQ ID NO: 1356 - DNA, 25 bp, synthetic construct
  misc_feature 1..25: note = Synthetic
  source 1..25: mol_type = other DNA
tgttactctggtgacacaacctgtg

SEQ ID NO: 1357 - DNA, 20 bp, synthetic construct
  misc_feature 1..20: note = Synthetic
  source 1..20: mol_type = other DNA
gttactctggtgacacaacc

SEQ ID NO: 1358 - DNA, 30 bp, synthetic construct
  misc_feature 1..30: note = Synthetic
  source 1..30: mol_type = other DNA
gttactctggtgacacaacctgtggttact

SEQ ID NO: 1359 - DNA, 25 bp, synthetic construct
  misc_feature 1..25: note = Synthetic
  source 1..25: mol_type = other DNA
gttactctggtgacacaacctgtgg

SEQ ID NO: 1360 - DNA, 20 bp, synthetic construct
  misc_feature 1..20: note = Synthetic
  source 1..20: mol_type = other DNA
ttactctggtgacacaacct

SEQ ID NO: 1361 - DNA, 30 bp, synthetic construct
  misc_feature 1..30: note = Synthetic
  source 1..30: mol_type = other DNA
ttactctggtgacacaacctgtggttacta

SEQ ID NO: 1362 - DNA, 25 bp, synthetic construct
  misc_feature 1..25: note = Synthetic
  source 1..25: mol_type = other DNA
ttactctggtgacacaacctgtggt

SEQ ID NO: 1363 - DNA, 26 bp, synthetic construct
  misc_feature 1..26: note = Synthetic
  source 1..26: mol_type = other DNA
ttactctggtgacacaacctgtggtt

SEQ ID NO: 1364 - DNA, 20 bp, synthetic construct
  misc_feature 1..20: note = Synthetic
  source 1..20: mol_type = other DNA
tactctggtgacacaacctg

SEQ ID NO: 1365 - DNA, 30 bp, synthetic construct
  misc_feature 1..30: note = Synthetic
  source 1..30: mol_type = other DNA
tactctggtgacacaacctgtggttactaa

SEQ ID NO: 1366 - DNA, 25 bp, synthetic construct
  misc_feature 1..25: note = Synthetic
  source 1..25: mol_type = other DNA
tactctggtgacacaacctgtggtt

SEQ ID NO: 1367 - DNA, 20 bp, synthetic construct
  misc_feature 1..20: note = Synthetic
  source 1..20: mol_type = other DNA
actctggtgacacaacctgt

SEQ ID NO: 1368 - DNA, 30 bp, synthetic construct
  misc_feature 1..30: note = Synthetic
  source 1..30: mol_type = other DNA
actctggtgacacaacctgtggttactaag

SEQ ID NO: 1369 - DNA, 25 bp, synthetic construct
  misc_feature 1..25: note = Synthetic
  source 1..25: mol_type = other DNA
actctggtgacacaacctgtggtta

SEQ ID NO: 1370 - DNA, 20 bp, synthetic construct
  misc_feature 1..20: note = Synthetic
  source 1..20: mol_type = other DNA
ctctggtgacacaacctgtg

SEQ ID NO: 1371 - DNA, 30 bp, synthetic construct
  misc_feature 1..30: note = Synthetic
  source 1..30: mol_type = other DNA
ctctggtgacacaacctgtggttactaagg

SEQ ID NO: 1372 - DNA, 25 bp, synthetic construct
  misc_feature 1..25: note = Synthetic
  source 1..25: mol_type = other DNA
ctctggtgacacaacctgtggttac

SEQ ID NO: 1373 - DNA, 20 bp, synthetic construct
  misc_feature 1..20: note = Synthetic
  source 1..20: mol_type = other DNA
tctggtgacacaacctgtgg

SEQ ID NO: 1374 - DNA, 30 bp, synthetic construct
  misc_feature 1..30: note = Synthetic
  source 1..30: mol_type = other DNA
tctggtgacacaacctgtggttactaagga

SEQ ID NO: 1375 - DNA, 25 bp, synthetic construct
  misc_feature 1..25: note = Synthetic
  source 1..25: mol_type = other DNA
tctggtgacacaacctgtggttact

SEQ ID NO: 1376 - DNA, 20 bp, synthetic construct
  misc_feature 1..20: note = Synthetic
  source 1..20: mol_type = other DNA
ctggtgacacaacctgtggt

SEQ ID NO: 1377 - DNA, 30 bp, synthetic construct
  misc_feature 1..30: note = Synthetic
  source 1..30: mol_type = other DNA
ctggtgacacaacctgtggttactaaggaa

SEQ ID NO: 1378 - DNA, 19 bp, synthetic construct
  misc_feature 1..19: note = Synthetic
  source 1..19: mol_type = other DNA
ctggtgacacaacctgtgg

SEQ ID NO: 1379 - DNA, 25 bp, synthetic construct
  misc_feature 1..25: note = Synthetic
  source 1..25: mol_type = other DNA
ctggtgacacaacctgtggttacta

SEQ ID NO: 1380 - DNA, 21 bp, synthetic construct
  misc_feature 1..21: note = Synthetic
  source 1..21: mol_type = other DNA
ctggtgacacaacctgtggtt

SEQ ID NO: 1381 - DNA, 20 bp, synthetic construct
  misc_feature 1..20: note = Synthetic
  source 1..20: mol_type = other DNA
tggtgacacaacctgtggtt

SEQ ID NO: 1382 - DNA, 30 bp, synthetic construct
  misc_feature 1..30: note = Synthetic
  source 1..30: mol_type = other DNA
tggtgacacaacctgtggttactaaggaaa

SEQ ID NO: 1383 - DNA, 25 bp, synthetic construct
  misc_feature 1..25: note = Synthetic
  source 1..25: mol_type = other DNA
tggtgacacaacctgtggttactaa

SEQ ID NO: 1384 - DNA, 20 bp, synthetic construct
  misc_feature 1..20: note = Synthetic
  source 1..20: mol_type = other DNA
ggtgacacaacctgtggtta

SEQ ID NO: 1385 - DNA, 30 bp, synthetic construct
  misc_feature 1..30: note = Synthetic
  source 1..30: mol_type = other DNA
ggtgacacaacctgtggttactaaggaaac

SEQ ID NO: 1386 - DNA, 23 bp, synthetic construct
  misc_feature 1..23: note = Synthetic
  source 1..23: mol_type = other DNA
ggtgacacaacctgtggttacta

SEQ ID NO: 1387 - DNA, 25 bp, synthetic construct
  misc_feature 1..25: note = Synthetic
  source 1..25: mol_type = other DNA
ggtgacacaacctgtggttactaag

SEQ ID NO: 1388 - DNA, 20 bp, synthetic construct
  misc_feature 1..20: note = Synthetic
  source 1..20: mol_type = other DNA
gtgacacaacctgtggttac

SEQ ID NO: 1389 - DNA, 30 bp, synthetic construct
  misc_feature 1..30: note = Synthetic
  source 1..30: mol_type = other DNA
gtgacacaacctgtggttactaaggaaact

SEQ ID NO: 1390 - DNA, 25 bp, synthetic construct
  misc_feature 1..25: note = Synthetic
  source 1..25: mol_type = other DNA
gtgacacaacctgtggttactaagg

SEQ ID NO: 1391 - DNA, 21 bp, synthetic construct
  misc_feature 1..21: note = Synthetic
  source 1..21: mol_type = other DNA
gtgacacaacctgtggttact

SEQ ID NO: 1392 - DNA, 24 bp, synthetic construct
  misc_feature 1..24: note = Synthetic
  source 1..24: mol_type = other DNA
gtgacacaacctgtggttactaag

SEQ ID NO: 1393 - DNA, 20 bp, synthetic construct
  misc_feature 1..20: note = Synthetic
  source 1..20: mol_type = other DNA
tgacacaacctgtggttact

SEQ ID NO: 1394 - DNA, 30 bp, synthetic construct
  misc_feature 1..30: note = Synthetic
  source 1..30: mol_type = other DNA
tgacacaacctgtggttactaaggaaactg

SEQ ID NO: 1395 - DNA, 25 bp, synthetic construct
  misc_feature 1..25: note = Synthetic
  source 1..25: mol_type = other DNA
tgacacaacctgtggttactaagga

SEQ ID NO: 1396 - DNA, 20 bp, synthetic construct
  misc_feature 1..20: note = Synthetic
  source 1..20: mol_type = other DNA
gacacaacctgtggttacta

SEQ ID NO: 1397 - DNA, 30 bp, synthetic construct
  misc_feature 1..30: note = Synthetic
  source 1..30: mol_type = other DNA
gacacaacctgtggttactaaggaaactgc

SEQ ID NO: 1398 - DNA, 25 bp, synthetic construct
  misc_feature 1..25: note = Synthetic
  source 1..25: mol_type = other DNA
gacacaacctgtggttactaaggaa

SEQ ID NO: 1399 - DNA, 27 bp, synthetic construct
  misc_feature 1..27: note = Synthetic
  source 1..27: mol_type = other DNA
gacacaacctgtggttactaaggaaac

SEQ ID NO: 1400 - DNA, 20 bp, synthetic construct
  misc_feature 1..20: note = Synthetic
  source 1..20: mol_type = other DNA
acacaacctgtggttactaa

SEQ ID NO: 1401 - DNA, 30 bp, synthetic construct
  misc_feature 1..30: note = Synthetic
  source 1..30: mol_type = other DNA
acacaacctgtggttactaaggaaactgcc

SEQ ID NO: 1402 - DNA, 25 bp, synthetic construct
  misc_feature 1..25: note = Synthetic
  source 1..25: mol_type = other DNA
acacaacctgtggttactaaggaaa

SEQ ID NO: 1403 - DNA, 20 bp, synthetic construct
  misc_feature 1..20: note = Synthetic
  source 1..20: mol_type = other DNA
cacaacctgtggttactaag

SEQ ID NO: 1404 - DNA, 30 bp, synthetic construct
  misc_feature 1..30: note = Synthetic
  source 1..30: mol_type = other DNA
cacaacctgtggttactaaggaaactgcca

SEQ ID NO: 1405 - DNA, 25 bp, synthetic construct
  misc_feature 1..25: note = Synthetic
  source 1..25: mol_type = other DNA
cacaacctgtggttactaaggaaac

SEQ ID NO: 1406 - DNA, 20 bp, synthetic construct
  misc_feature 1..20: note = Synthetic
  source 1..20: mol_type = other DNA
acaacctgtggttactaagg

SEQ ID NO: 1407 - DNA, 30 bp, synthetic construct
  misc_feature 1..30: note = Synthetic
  source 1..30: mol_type = other DNA
acaacctgtggttactaaggaaactgccat

SEQ ID NO: 1408 - DNA, 25 bp, synthetic construct
  misc_feature 1..25: note = Synthetic
  source 1..25: mol_type = other DNA
acaacctgtggttactaaggaaact

SEQ ID NO: 1409 - DNA, 20 bp, synthetic construct
  misc_feature 1..20: note = Synthetic
  source 1..20: mol_type = other DNA
caacctgtggttactaagga

SEQ ID NO: 1410 - DNA, 30 bp, synthetic construct
  misc_feature 1..30: note = Synthetic
  source 1..30: mol_type = other DNA
caacctgtggttactaaggaaactgccatc

SEQ ID NO: 1411 - DNA, 25 bp, synthetic construct
  misc_feature 1..25: note = Synthetic
  source 1..25: mol_type = other DNA
caacctgtggttactaaggaaactg

SEQ ID NO: 1412 - DNA, 20 bp, synthetic construct
  misc_feature 1..20: note = Synthetic
  source 1..20: mol_type = other DNA
aacctgtggttactaaggaa

SEQ ID NO: 1413 - DNA, 30 bp, synthetic construct
  misc_feature 1..30: note = Synthetic
  source 1..30: mol_type = other DNA
aacctgtggttactaaggaaactgccatct

SEQ ID NO: 1414 - DNA, 25 bp, synthetic construct
  misc_feature 1..25: note = Synthetic
  source 1..25: mol_type = other DNA
aacctgtggttactaaggaaactgc

SEQ ID NO: 1415 - DNA, 21 bp, synthetic construct
  misc_feature 1..21: note = Synthetic
  source 1..21: mol_type = other DNA
aacctgtggttactaaggaaa

SEQ ID NO: 1416 - DNA, 20 bp, synthetic construct
  misc_feature 1..20: note = Synthetic
  source 1..20: mol_type = other DNA
acctgtggttactaaggaaa

SEQ ID NO: 1417 - DNA, 30 bp, synthetic construct
  misc_feature 1..30: note = Synthetic
  source 1..30: mol_type = other DNA
acctgtggttactaaggaaactgccatctc

SEQ ID NO: 1418 - DNA, 25 bp, synthetic construct
  misc_feature 1..25: note = Synthetic
  source 1..25: mol_type = other DNA
acctgtggttactaaggaaactgcc

SEQ ID NO: 1419 - DNA, 19 bp, synthetic construct
  misc_feature 1..19: note = Synthetic
  source 1..19: mol_type = other DNA
acctgtggttactaaggaa

SEQ ID NO: 1420 - DNA, 26 bp, synthetic construct
  misc_feature 1..26: note = Synthetic
  source 1..26: mol_type = other DNA
acctgtggttactaaggaaactgcca

SEQ ID NO: 1421 - DNA, 20 bp, synthetic construct
  misc_feature 1..20: note = Synthetic
  source 1..20: mol_type = other DNA
cctgtggttactaaggaaac

SEQ ID NO: 1422 - DNA, 30 bp, synthetic construct
  misc_feature 1..30: note = Synthetic
  source 1..30: mol_type = other DNA
cctgtggttactaaggaaactgccatctcc

SEQ ID NO: 1423 - DNA, 25 bp, synthetic construct
  misc_feature 1..25: note = Synthetic
  source 1..25: mol_type = other DNA
cctgtggttactaaggaaactgcca

SEQ ID NO: 1424 - DNA, 20 bp, synthetic construct
  misc_feature 1..20: note = Synthetic
  source 1..20: mol_type = other DNA
ctgtggttactaaggaaact

SEQ ID NO: 1425 - DNA, 30 bp, synthetic construct
  misc_feature 1..30: note = Synthetic
  source 1..30: mol_type = other DNA
ctgtggttactaaggaaactgccatctcca

SEQ ID NO: 1426 - DNA, 25 bp, synthetic construct
  misc_feature 1..25: note = Synthetic
  source 1..25: mol_type = other DNA
ctgtggttactaaggaaactgccat

SEQ ID NO: 1427 - DNA, 19 bp, synthetic construct
  misc_feature 1..19: note = Synthetic
  source 1..19: mol_type = other DNA
ctgtggttactaaggaaac

SEQ ID NO: 1428 - DNA, 20 bp, synthetic construct
  misc_feature 1..20: note = Synthetic
  source 1..20: mol_type = other DNA
tgtggttactaaggaaactg

SEQ ID NO: 1429 - DNA, 30 bp, synthetic construct
  misc_feature 1..30: note = Synthetic
  source 1..30: mol_type = other DNA
tgtggttactaaggaaactgccatctccaa

SEQ ID NO: 1430 - DNA, 25 bp, synthetic construct
  misc_feature 1..25: note = Synthetic
  source 1..25: mol_type = other DNA
tgtggttactaaggaaactgccatc

SEQ ID NO: 1431 - DNA, 20 bp, synthetic construct
  misc_feature 1..20: note = Synthetic
  source 1..20: mol_type = other DNA
gtggttactaaggaaactgc

SEQ ID NO: 1432 - DNA, 30 bp, synthetic construct
  misc_feature 1..30: note = Synthetic
  source 1..30: mol_type = other DNA
gtggttactaaggaaactgccatctccaaa

SEQ ID NO: 1433 - DNA, 25 bp, synthetic construct
  misc_feature 1..25: note = Synthetic
  source 1..25: mol_type = other DNA
gtggttactaaggaaactgccatct

SEQ ID NO: 1434 - DNA, 20 bp, synthetic construct
  misc_feature 1..20: note = Synthetic
  source 1..20: mol_type = other DNA
tggttactaaggaaactgcc

SEQ ID NO: 1435 - DNA, 30 bp, synthetic construct
  misc_feature 1..30: note = Synthetic
  source 1..30: mol_type = other DNA
tggttactaaggaaactgccatctccaaac

SEQ ID NO: 1436 - DNA, 25 bp, synthetic construct
  misc_feature 1..25: note = Synthetic
  source 1..25: mol_type = other DNA
tggttactaaggaaactgccatctc

SEQ ID NO: 1437 - DNA, 20 bp, synthetic construct
  misc_feature 1..20: note = Synthetic
  source 1..20: mol_type = other DNA
ggttactaaggaaactgcca

SEQ ID NO: 1438 - DNA, 30 bp, synthetic construct
  misc_feature 1..30: note = Synthetic
  source 1..30: mol_type = other DNA
ggttactaaggaaactgccatctccaaact

SEQ ID NO: 1439 - DNA, 23 bp, synthetic construct
  misc_feature 1..23: note = Synthetic
  source 1..23: mol_type = other DNA
ggttactaaggaaactgccatct

SEQ ID NO: 1440 - DNA, 25 bp, synthetic construct
  misc_feature 1..25: note = Synthetic
  source 1..25: mol_type = other DNA
ggttactaaggaaactgccatctcc

SEQ ID NO: 1441 - DNA, 24 bp, synthetic construct
  misc_feature 1..24: note = Synthetic
  source 1..24: mol_type = other DNA
ggttactaaggaaactgccatctc

SEQ ID NO: 1442 - DNA, 20 bp, synthetic construct
  misc_feature 1..20: note = Synthetic
  source 1..20: mol_type = other DNA
gttactaaggaaactgccat

SEQ ID NO: 1443 - DNA, 30 bp, synthetic construct
  misc_feature 1..30: note = Synthetic
  source 1..30: mol_type = other DNA
gttactaaggaaactgccatctccaaacta

SEQ ID NO: 1444 - DNA, 25 bp, synthetic construct
  misc_feature 1..25: note = Synthetic
  source 1..25: mol_type = other DNA
gttactaaggaaactgccatctcca

SEQ ID NO: 1445 - DNA, 19 bp, synthetic construct
  misc_feature 1..19: note = Synthetic
  source 1..19: mol_type = other DNA
gttactaaggaaactgcca

SEQ ID NO: 1446 - DNA, 20 bp, synthetic construct
  misc_feature 1..20: note = Synthetic
  source 1..20: mol_type = other DNA
ttactaaggaaactgccatc

SEQ ID NO: 1447 - DNA, 30 bp, synthetic construct
  misc_feature 1..30: note = Synthetic
  source 1..30: mol_type = other DNA
ttactaaggaaactgccatctccaaactag

SEQ ID NO: 1448 - DNA, 25 bp, synthetic construct
  misc_feature 1..25: note = Synthetic
  source 1..25: mol_type = other DNA
ttactaaggaaactgccatctccaa

SEQ ID NO: 1449 - DNA, 28 bp, synthetic construct
  misc_feature 1..28: note = Synthetic
  source 1..28: mol_type = other DNA
ttactaaggaaactgccatctccaaact

SEQ ID NO: 1450 - DNA, 38 bp, synthetic construct
  misc_feature 1..38: note = Synthetic
  source 1..38: mol_type = other DNA
ttactaaggaaactgccatctccaaactagaaatgcca

SEQ ID NO: 1451 - DNA, 20 bp, synthetic construct
  misc_feature 1..20: note = Synthetic
  source 1..20: mol_type = other DNA
tactaaggaaactgccatct

SEQ ID NO: 1452 - DNA, 30 bp, synthetic construct
  misc_feature 1..30: note = Synthetic
  source 1..30: mol_type = other DNA
tactaaggaaactgccatctccaaactaga

SEQ ID NO: 1453 - DNA, 25 bp, synthetic construct
  misc_feature 1..25: note = Synthetic
  source 1..25: mol_type = other DNA
tactaaggaaactgccatctccaaa

SEQ ID NO: 1454 - DNA, 21 bp, synthetic construct
  misc_feature 1..21: note = Synthetic
  source 1..21: mol_type = other DNA
tactaaggaaactgccatctc

SEQ ID NO: 1455 - DNA, 20 bp, synthetic construct
  misc_feature 1..20: note = Synthetic
  source 1..20: mol_type = other DNA
actaaggaaactgccatctc

SEQ ID NO: 1456 - DNA, 30 bp, synthetic construct
  misc_feature 1..30: note = Synthetic
  source 1..30: mol_type = other DNA
actaaggaaactgccatctccaaactagaa

SEQ ID NO: 1457 - DNA, 25 bp, synthetic construct
  misc_feature 1..25: note = Synthetic
  source 1..25: mol_type = other DNA
actaaggaaactgccatctccaaac

SEQ ID NO: 1458 - DNA, 18 bp, synthetic construct
  misc_feature 1..18: note = Synthetic
  source 1..18: mol_type = other DNA
actaaggaaactgccatc

SEQ ID NO: 1459 - DNA, 31 bp, synthetic construct
  misc_feature 1..31: note = Synthetic
  source 1..31: mol_type = other DNA
actaaggaaactgccatctccaaactagaaa

SEQ ID NO: 1460 - DNA, 20 bp, synthetic construct
  misc_feature 1..20: note = Synthetic
  source 1..20: mol_type = other DNA
ctaaggaaactgccatctcc

SEQ ID NO: 1461 - DNA, 30 bp, synthetic construct
  misc_feature 1..30: note = Synthetic
  source 1..30: mol_type = other DNA
ctaaggaaactgccatctccaaactagaaa

SEQ ID NO: 1462 - DNA, 25 bp, synthetic construct
  misc_feature 1..25: note = Synthetic
  source 1..25: mol_type = other DNA
ctaaggaaactgccatctccaaact

SEQ ID NO: 1463 - DNA, 20 bp, synthetic construct
  misc_feature 1..20: note = Synthetic
  source 1..20: mol_type = other DNA
taaggaaactgccatctcca

SEQ ID NO: 1464 - DNA, 30 bp, synthetic construct
  misc_feature 1..30: note = Synthetic
  source 1..30: mol_type = other DNA
taaggaaactgccatctccaaactagaaat

SEQ ID NO: 1465 - DNA, 25 bp, synthetic construct
  misc_feature 1..25: note = Synthetic
  source 1..25: mol_type = other DNA
taaggaaactgccatctccaaacta

SEQ ID NO: 1466 - DNA, 20 bp, synthetic construct
  misc_feature 1..20: note = Synthetic
  source 1..20: mol_type = other DNA
aaggaaactgccatctccaa

SEQ ID NO: 1467 - DNA, 30 bp, synthetic construct
  misc_feature 1..30: note = Synthetic
  source 1..30: mol_type = other DNA
aaggaaactgccatctccaaactagaaatg

SEQ ID NO: 1468 - DNA, 25 bp, synthetic construct
  misc_feature 1..25: note = Synthetic
  source 1..25: mol_type = other DNA
aaggaaactgccatctccaaactag

SEQ ID NO: 1469 - DNA, 24 bp, synthetic construct
  misc_feature 1..24: note = Synthetic
  source 1..24: mol_type = other DNA
aaggaaactgccatctccaaacta

SEQ ID NO: 1470 - DNA, 20 bp, synthetic construct
  misc_feature 1..20: note = Synthetic
  source 1..20: mol_type = other DNA
aggaaactgccatctccaaa

SEQ ID NO: 1471 - DNA, 30 bp, synthetic construct
  misc_feature 1..30: note = Synthetic
  source 1..30: mol_type = other DNA
aggaaactgccatctccaaactagaaatgc

SEQ ID NO: 1472 - DNA, 25 bp, synthetic construct
  misc_feature 1..25: note = Synthetic
  source 1..25: mol_type = other DNA
aggaaactgccatctccaaactaga

SEQ ID NO: 1473 - DNA, 31 bp, synthetic construct
  misc_feature 1..31: note = Synthetic
  source 1..31: mol_type = other DNA
aggaaactgccatctccaaactagaaatgcc

SEQ ID NO: 1474 - DNA, 20 bp, synthetic construct
  misc_feature 1..20: note = Synthetic
  source 1..20: mol_type = other DNA
ggaaactgccatctccaaac

SEQ ID NO: 1475 - DNA, 30 bp, synthetic construct
  misc_feature 1..30: note = Synthetic
  source 1..30: mol_type = other DNA
ggaaactgccatctccaaactagaaatgcc

SEQ ID NO: 1476 - DNA, 25 bp, synthetic construct
  misc_feature 1..25: note = Synthetic
  source 1..25: mol_type = other DNA
ggaaactgccatctccaaactagaa

SEQ ID NO: 1477 - DNA, 43 bp, synthetic construct
  misc_feature 1..43: note = Synthetic
  source 1..43: mol_type = other DNA
ggaaactgccatctccaaactagaaatgccatcttccttgatg

SEQ ID NO: 1478 - DNA, 20 bp, synthetic construct
  misc_feature 1..20: note = Synthetic
  source 1..20: mol_type = other DNA
gaaactgccatctccaaact

SEQ ID NO: 1479 - DNA, 30 bp, synthetic construct
  misc_feature 1..30: note = Synthetic
  source 1..30: mol_type = other DNA
gaaactgccatctccaaactagaaatgcca

SEQ ID NO: 1480 - DNA, 25 bp, synthetic construct
  misc_feature 1..25: note = Synthetic
  source 1..25: mol_type = other DNA
gaaactgccatctccaaactagaaa

SEQ ID NO: 1481 - DNA, 26 bp, synthetic construct
  misc_feature 1..26: note = Synthetic
  source 1..26: mol_type = other DNA
gaaactgccatctccaaactagaaat

SEQ ID NO: 1482 - DNA, 20 bp, synthetic construct
  misc_feature 1..20: note = Synthetic
  source 1..20: mol_type = other DNA
aaactgccatctccaaacta

SEQ ID NO: 1483 - DNA, 30 bp, synthetic construct
  misc_feature 1..30: note = Synthetic
  source 1..30: mol_type = other DNA
aaactgccatctccaaactagaaatgccat

SEQ ID NO: 1484 - DNA, 25 bp, synthetic construct
  misc_feature 1..25: note = Synthetic
  source 1..25: mol_type = other DNA
aaactgccatctccaaactagaaat

SEQ ID NO: 1485 - DNA, 20 bp, synthetic construct
  misc_feature 1..20: note = Synthetic
  source 1..20: mol_type = other DNA
aactgccatctccaaactag

SEQ ID NO: 1486 - DNA, 30 bp, synthetic construct
  misc_feature 1..30: note = Synthetic
  source 1..30: mol_type = other DNA
aactgccatctccaaactagaaatgccatc

SEQ ID NO: 1487 - DNA, 25 bp, synthetic construct
  misc_feature 1..25: note = Synthetic
  source 1..25: mol_type = other DNA
aactgccatctccaaactagaaatg

SEQ ID NO: 1488 - DNA, 18 bp, synthetic construct
  misc_feature 1..18: note = Synthetic
  source 1..18: mol_type = other DNA
aactgccatctccaaact

SEQ ID NO: 1489 - DNA, 20 bp, synthetic construct
  misc_feature 1..20: note = Synthetic
  source 1..20: mol_type = other DNA
actgccatctccaaactaga

SEQ ID NO: 1490 - DNA, 30 bp, synthetic construct
  misc_feature 1..30: note = Synthetic
  source 1..30: mol_type = other DNA
actgccatctccaaactagaaatgccatct

SEQ ID NO: 1491 - DNA, 25 bp, synthetic construct
  misc_feature 1..25: note = Synthetic
  source 1..25: mol_type = other DNA
actgccatctccaaactagaaatgc

SEQ ID NO: 1492 - DNA, 21 bp, synthetic construct
  misc_feature 1..21: note = Synthetic
  source 1..21: mol_type = other DNA
actgccatctccaaactagaa

SEQ ID NO: 1493 - DNA, 20 bp, synthetic construct
  misc_feature 1..20: note = Synthetic
  source 1..20: mol_type = other DNA
ctgccatctccaaactagaa

SEQ ID NO: 1494 - DNA, 30 bp, synthetic construct
  misc_feature 1..30: note = Synthetic
  source 1..30: mol_type = other DNA
ctgccatctccaaactagaaatgccatctt

SEQ ID NO: 1495 - DNA, 25 bp, synthetic construct
  misc_feature 1..25: note = Synthetic
  source 1..25: mol_type = other DNA
ctgccatctccaaactagaaatgcc

SEQ ID NO: 1496 - DNA, 26 bp, synthetic construct
  misc_feature 1..26: note = Synthetic
  source 1..26: mol_type = other DNA
ctgccatctccaaactagaaatgcca

SEQ ID NO: 1497 - DNA, 20 bp, synthetic construct
  misc_feature 1..20: note = Synthetic
  source 1..20: mol_type = other DNA
tgccatctccaaactagaaa

SEQ ID NO: 1498 - DNA, 30 bp, synthetic construct
  misc_feature 1..30: note = Synthetic
  source 1..30: mol_type = other DNA
tgccatctccaaactagaaatgccatcttc

SEQ ID NO: 1499 - DNA, 25 bp, synthetic construct
  misc_feature 1..25: note = Synthetic
  source 1..25: mol_type = other DNA
tgccatctccaaactagaaatgcca

SEQ ID NO: 1500 - DNA, 27 bp, synthetic construct
  misc_feature 1..27: note = Synthetic
  source 1..27: mol_type = other DNA
tgccatctccaaactagaaatgccatc

SEQ ID NO: 1501 - DNA, 20 bp, synthetic construct
  misc_feature 1..20: note = Synthetic
  source 1..20: mol_type = other DNA
gccatctccaaactagaaat

SEQ ID NO: 1502 - DNA, 30 bp, synthetic construct
  misc_feature 1..30: note = Synthetic
  source 1..30: mol_type = other DNA
gccatctccaaactagaaatgccatcttcc

SEQ ID NO: 1503 - DNA, 25 bp, synthetic construct
  misc_feature 1..25: note = Synthetic
  source 1..25: mol_type = other DNA
gccatctccaaactagaaatgccat

SEQ ID NO: 1504 - DNA, 20 bp, synthetic construct
  misc_feature 1..20: note = Synthetic
  source 1..20: mol_type = other DNA
ccatctccaaactagaaatg

SEQ ID NO: 1505 - DNA, 30 bp, synthetic construct
  misc_feature 1..30: note = Synthetic
  source 1..30: mol_type = other DNA
ccatctccaaactagaaatgccatcttcct

SEQ ID NO: 1506 - DNA, 25 bp, synthetic construct
  misc_feature 1..25: note = Synthetic
  source 1..25: mol_type = other DNA
ccatctccaaactagaaatgccatc

SEQ ID NO: 1507 - DNA, 20 bp, synthetic construct
  misc_feature 1..20: note = Synthetic
  source 1..20: mol_type = other DNA
catctccaaactagaaatgc

SEQ ID NO: 1508 - DNA, 30 bp, synthetic construct
  misc_feature 1..30: note = Synthetic
  source 1..30: mol_type = other DNA
catctccaaactagaaatgccatcttcctt

SEQ ID NO: 1509 - DNA, 19 bp, synthetic construct
  misc_feature 1..19: note = Synthetic
  source 1..19: mol_type = other DNA
catctccaaactagaaatg

SEQ ID NO: 1510 - DNA, 25 bp, synthetic construct
  misc_feature 1..25: note = Synthetic
  source 1..25: mol_type = other DNA
catctccaaactagaaatgccatct

SEQ ID NO: 1511 - DNA, 21 bp, synthetic construct
  misc_feature 1..21: note = Synthetic
  source 1..21: mol_type = other DNA
catctccaaactagaaatgcc

SEQ ID NO: 1512 - DNA, 20 bp, synthetic construct
  misc_feature 1..20: note = Synthetic
  source 1..20: mol_type = other DNA
atctccaaactagaaatgcc

SEQ ID NO: 1513 - DNA, 30 bp, synthetic construct
  misc_feature 1..30: note = Synthetic
  source 1..30: mol_type = other DNA
atctccaaactagaaatgccatcttccttg

SEQ ID NO: 1514 - DNA, 25 bp, synthetic construct
  misc_feature 1..25: note = Synthetic
  source 1..25: mol_type = other DNA
atctccaaactagaaatgccatctt

SEQ ID NO: 1515 - DNA, 29 bp, synthetic construct
  misc_feature 1..29: note = Synthetic
  source 1..29: mol_type = other DNA
atctccaaactagaaatgccatcttcctt

SEQ ID NO: 1516 - DNA, 20 bp, synthetic construct
  misc_feature 1..20: note = Synthetic
  source 1..20: mol_type = other DNA
tctccaaactagaaatgcca

SEQ ID NO: 1517 - DNA, 30 bp, synthetic construct
  misc_feature 1..30: note = Synthetic
  source 1..30: mol_type = other DNA
tctccaaactagaaatgccatcttccttga

SEQ ID NO: 1518 - DNA, 25 bp, synthetic construct
  misc_feature 1..25: note = Synthetic
  source 1..25: mol_type = other DNA
tctccaaactagaaatgccatcttc

SEQ ID NO: 1519 - DNA, 20 bp, synthetic construct
  misc_feature 1..20: note = Synthetic
  source 1..20: mol_type = other DNA
ctccaaactagaaatgccat

SEQ ID NO: 1520 - DNA, 30 bp, synthetic construct
  misc_feature 1..30: note = Synthetic
  source 1..30: mol_type = other DNA
ctccaaactagaaatgccatcttccttgat

SEQ ID NO: 1521 - DNA, 18 bp, synthetic construct
  misc_feature 1..18: note = Synthetic
  source 1..18: mol_type = other DNA
ctccaaactagaaatgcc

SEQ ID NO: 1522 - DNA, 25 bp, synthetic construct
  misc_feature 1..25: note = Synthetic
  source 1..25: mol_type = other DNA
ctccaaactagaaatgccatcttcc

SEQ ID NO: 1523 - DNA, 45 bp, synthetic construct
  misc_feature 1..45: note = Synthetic
  source 1..45: mol_type = other DNA
ctccaaactagaaatgccatcttccttgatgttggaggtacctgc

SEQ ID NO: 1524 - DNA, 20 bp, synthetic construct
  misc_feature 1..20: note = Synthetic
  source 1..20: mol_type = other DNA
tccaaactagaaatgccatc

SEQ ID NO: 1525 - DNA, 30 bp, synthetic construct
  misc_feature 1..30: note = Synthetic
  source 1..30: mol_type = other DNA
tccaaactagaaatgccatcttccttgatg

SEQ ID NO: 1526 - DNA, 25 bp, synthetic construct
  misc_feature 1..25: note = Synthetic
  source 1..25: mol_type = other DNA
tccaaactagaaatgccatcttcct

SEQ ID NO: 1527 - DNA, 20 bp, synthetic construct
  misc_feature 1..20: note = Synthetic
  source 1..20: mol_type = other DNA
ccaaactagaaatgccatct

SEQ ID NO: 1528 - DNA, 30 bp, synthetic construct
  misc_feature 1..30: note = Synthetic
  source 1..30: mol_type = other DNA
ccaaactagaaatgccatcttccttgatgt

SEQ ID NO: 1529 - DNA, 25 bp, synthetic construct
  misc_feature 1..25: note = Synthetic
  source 1..25: mol_type = other DNA
ccaaactagaaatgccatcttcctt

SEQ ID NO: 1530 - DNA, 18 bp, synthetic construct
  misc_feature 1..18: note = Synthetic
  source 1..18: mol_type = other DNA
ccaaactagaaatgccat

SEQ ID NO: 1531 - DNA, 21 bp, synthetic construct
  misc_feature 1..21: note = Synthetic
  source 1..21: mol_type = other DNA
ccaaactagaaatgccatctt

SEQ ID NO: 1532 - DNA, 22 bp, synthetic construct
  misc_feature 1..22: note = Synthetic
  source 1..22: mol_type = other DNA
ccaaactagaaatgccatcttc

SEQ ID NO: 1533 - DNA, 23 bp, synthetic construct
  misc_feature 1..23: note = Synthetic
  source 1..23: mol_type = other DNA
ccaaactagaaatgccatcttcc

SEQ ID NO: 1534 - DNA, 29 bp, synthetic construct
  misc_feature 1..29: note = Synthetic
  source 1..29: mol_type = other DNA
ccaaactagaaatgccatcttccttgatg

SEQ ID NO: 1535 - DNA, 20 bp, synthetic construct
  misc_feature 1..20: note = Synthetic
  source 1..20: mol_type = other DNA
caaactagaaatgccatctt

SEQ ID NO: 1536 - DNA, 30 bp, synthetic construct
  misc_feature 1..30: note = Synthetic
  source 1..30: mol_type = other DNA
caaactagaaatgccatcttccttgatgtt

SEQ ID NO: 1537 - DNA, 25 bp, synthetic construct
  misc_feature 1..25: note = Synthetic
  source 1..25: mol_type = other DNA
caaactagaaatgccatcttccttg

SEQ ID NO: 1538 - DNA, 42 bp, synthetic construct
  misc_feature 1..42: note = Synthetic
  source 1..42: mol_type = other DNA
caaactagaaatgccatcttccttgatgttggaggtacctgc

SEQ ID NO: 1539 - DNA, 25 bp, synthetic construct
  misc_feature 1..25: note = Synthetic
  source 1..25: mol_type = other DNA
aaactagaaatgccatcttccttga

SEQ ID NO: 1540 - DNA, 30 bp, synthetic construct
  misc_feature 1..30: note = Synthetic
  source 1..30: mol_type = other DNA
aaactagaaatgccatcttccttgatgttg

SEQ ID NO: 1541 - DNA, 20 bp, synthetic construct
  misc_feature 1..20: note = Synthetic
  source 1..20: mol_type = other DNA
aaactagaaatgccatcttc

SEQ ID NO: 1542 - DNA, 40 bp, synthetic construct
  misc_feature 1..40: note = Synthetic
  source 1..40: mol_type = other DNA
aactagaaatgccatcttccttgatgttggaggtacctgc

SEQ ID NO: 1543 - DNA, 18 bp, synthetic construct
  misc_feature 1..18: note = Synthetic
  source 1..18: mol_type = other DNA
aactagaaatgccatctt

SEQ ID NO: 1544 - DNA, 25 bp, synthetic construct
  misc_feature 1..25: note = Synthetic
  source 1..25: mol_type = other DNA
aactagaaatgccatcttccttgat

SEQ ID NO: 1545 - DNA, 20 bp, synthetic construct
  misc_feature 1..20: note = Synthetic
  source 1..20: mol_type = other DNA
aactagaaatgccatcttcc

SEQ ID NO: 1546 - DNA, 26 bp, synthetic construct
  misc_feature 1..26: note = Synthetic
  source 1..26: mol_type = other DNA
aactagaaatgccatcttccttgatg

SEQ ID NO: 1547 - DNA, 30 bp, synthetic construct
  misc_feature 1..30: note = Synthetic
  source 1..30: mol_type = other DNA
aactagaaatgccatcttccttgatgttgg

SEQ ID NO: 1548 - DNA, 30 bp, synthetic construct
  misc_feature 1..30: note = Synthetic
  source 1..30: mol_type = other DNA
actagaaatgccatcttccttgatgttgga

SEQ ID NO: 1549 - DNA, 42 bp, synthetic construct
  misc_feature 1..42: note = Synthetic
  source 1..42: mol_type = other DNA
actagaaatgccatcttccttgatgttggaggtacctgctct

SEQ ID NO: 1550 - DNA, 30 bp, synthetic construct
  misc_feature 1..30: note = Synthetic
  source 1..30: mol_type = other DNA
ctagaaatgccatcttccttgatgttggag

SEQ ID NO: 1551 - DNA, 30 bp, synthetic construct
  misc_feature 1..30: note = Synthetic
  source 1..30: mol_type = other DNA
tagaaatgccatcttccttgatgttggagg

SEQ ID NO: 1552 - DNA, 30 bp, synthetic construct
  misc_feature 1..30: note = Synthetic
  source 1..30: mol_type = other DNA
agaaatgccatcttccttgatgttggaggt

SEQ ID NO: 1553 - DNA, 35 bp, synthetic construct
  misc_feature 1..35: note = Synthetic
  source 1..35: mol_type = other DNA
agaaatgccatcttccttgatgttggaggtacctg

SEQ ID NO: 1554 - DNA, 28 bp, synthetic construct
  misc_feature 1..28: note = Synthetic
  source 1..28: mol_type = other DNA
agaaatgccatcttccttgatgttggag

SEQ ID NO: 1555 - DNA, 30 bp, synthetic construct
  misc_feature 1..30: note = Synthetic
  source 1..30: mol_type = other DNA
gaaatgccatcttccttgatgttggaggta

SEQ ID NO: 1556 - DNA, 31 bp, synthetic construct
  misc_feature 1..31: note = Synthetic
  source 1..31: mol_type = other DNA
gaaatgccatcttccttgatgttggaggtac

SEQ ID NO: 1557 - DNA, 28 bp, synthetic construct
  misc_feature 1..28: note = Synthetic
  source 1..28: mol_type = other DNA
gaaatgccatcttccttgatgttggagg

SEQ ID NO: 1558 - DNA, 30 bp, synthetic construct
  misc_feature 1..30: note = Synthetic
  source 1..30: mol_type = other DNA
aaatgccatcttccttgatgttggaggtac

SEQ ID NO: 1559 - DNA, 30 bp, synthetic construct
  misc_feature 1..30: note = Synthetic
  source 1..30: mol_type = other DNA
aatgccatcttccttgatgttggaggtacc

SEQ ID NO: 1560 - DNA, 29 bp, synthetic construct
  misc_feature 1..29: note = Synthetic
  source 1..29: mol_type = other DNA
aatgccatcttccttgatgttggaggtac

SEQ ID NO: 1561 - DNA, 25 bp, synthetic construct
  misc_feature 1..25: note = Synthetic
  source 1..25: mol_type = other DNA
aatgccatcttccttgatgttggag

SEQ ID NO: 1562 - DNA, 30 bp, synthetic construct
  misc_feature 1..30: note = Synthetic
  source 1..30: mol_type = other DNA
atgccatcttccttgatgttggaggtacct

SEQ ID NO: 1563 - DNA, 28 bp, synthetic construct
  misc_feature 1..28: note = Synthetic
  source 1..28: mol_type = other DNA
atgccatcttccttgatgttggaggtac

SEQ ID NO: 1564 - DNA, 25 bp, synthetic construct
  misc_feature 1..25: note = Synthetic
  source 1..25: mol_type = other DNA
atgccatcttccttgatgttggagg

SEQ ID NO: 1565 - DNA, 30 bp, synthetic construct
  misc_feature 1..30: note = Synthetic
  source 1..30: mol_type = other DNA
tgccatcttccttgatgttggaggtacctg

SEQ ID NO: 1566 - DNA, 25 bp, synthetic construct
  misc_feature 1..25: note = Synthetic
  source 1..25: mol_type = other DNA
tgccatcttccttgatgttggaggt

SEQ ID NO: 1567 - DNA, 26 bp, synthetic construct
  misc_feature 1..26: note = Synthetic
  source 1..26: mol_type = other DNA
tgccatcttccttgatgttggaggta

SEQ ID NO: 1568 - DNA, 27 bp, synthetic construct
  misc_feature 1..27: note = Synthetic
  source 1..27: mol_type = other DNA
tgccatcttccttgatgttggaggtac

SEQ ID NO: 1569 - DNA, 30 bp, synthetic construct
  misc_feature 1..30: note = Synthetic
  source 1..30: mol_type = other DNA
gccatcttccttgatgttggaggtacctgc

SEQ ID NO: 1570 - DNA, 25 bp, synthetic construct
  misc_feature 1..25: note = Synthetic
  source 1..25: mol_type = other DNA
gccatcttccttgatgttggaggta

SEQ ID NO: 1571 - DNA, 26 bp, synthetic construct
  misc_feature 1..26: note = Synthetic
  source 1..26: mol_type = other DNA
gccatcttccttgatgttggaggtac

SEQ ID NO: 1572 - DNA, 27 bp, synthetic construct
  misc_feature 1..27: note = Synthetic
  source 1..27: mol_type = other DNA
gccatcttccttgatgttggaggtacc

SEQ ID NO: 1573 - DNA, 29 bp, synthetic construct
  misc_feature 1..29: note = Synthetic
  source 1..29: mol_type = other DNA
gccatcttccttgatgttggaggtacctg

SEQ ID NO: 1574 - DNA, 28 bp, synthetic construct
  misc_feature 1..28: note = Synthetic
  source 1..28: mol_type = other DNA
gccatcttccttgatgttggaggtacct

SEQ ID NO: 1575 - DNA, 24 bp, synthetic construct
  misc_feature 1..24: note = Synthetic
  source 1..24: mol_type = other DNA
gccatcttccttgatgttggaggt

SEQ ID NO: 1576 - DNA, 23 bp, synthetic construct
  misc_feature 1..23: note = Synthetic
  source 1..23: mol_type = other DNA
gccatcttccttgatgttggagg

SEQ ID NO: 1577 - DNA, 30 bp, synthetic construct
  misc_feature 1..30: note = Synthetic
  source 1..30: mol_type = other DNA
ccatcttccttgatgttggaggtacctgct

SEQ ID NO: 1578 - DNA, 27 bp, synthetic construct
  misc_feature 1..27: note = Synthetic
  source 1..27: mol_type = other DNA
ccatcttccttgatgttggaggtacct

SEQ ID NO: 1579 - DNA, 25 bp, synthetic construct
  misc_feature 1..25: note = Synthetic
  source 1..25: mol_type = other DNA
ccatcttccttgatgttggaggtac

SEQ ID NO: 1580 - DNA, 26 bp, synthetic construct
  misc_feature 1..26: note = Synthetic
  source 1..26: mol_type = other DNA
ccatcttccttgatgttggaggtacc

SEQ ID NO: 1581 - DNA, 21 bp, synthetic construct
  misc_feature 1..21: note = Synthetic
  source 1..21: mol_type = other DNA
ccatcttccttgatgttggag

SEQ ID NO: 1582 - DNA, 22 bp, synthetic construct
  misc_feature 1..22: note = Synthetic
  source 1..22: mol_type = other DNA
ccatcttccttgatgttggagg

SEQ ID NO: 1583 - DNA, 30 bp, synthetic construct
  misc_feature 1..30: note = Synthetic
  source 1..30: mol_type = other DNA
catcttccttgatgttggaggtacctgctc

SEQ ID NO: 1584 - DNA, 25 bp, synthetic construct
  misc_feature 1..25: note = Synthetic
  source 1..25: mol_type = other DNA
catcttccttgatgttggaggtacc

SEQ ID NO: 1585 - DNA, 29 bp, synthetic construct
  misc_feature 1..29: note = Synthetic
  source 1..29: mol_type = other DNA
catcttccttgatgttggaggtacctgct

SEQ ID NO: 1586 - DNA, 24 bp, synthetic construct
  misc_feature 1..24: note = Synthetic
  source 1..24: mol_type = other DNA
catcttccttgatgttggaggtac

SEQ ID NO: 1587 - DNA, 21 bp, synthetic construct
  misc_feature 1..21: note = Synthetic
  source 1..21: mol_type = other DNA
catcttccttgatgttggagg

SEQ ID NO: 1588 - DNA, 20 bp, synthetic construct
  misc_feature 1..20: note = Synthetic
  source 1..20: mol_type = other DNA
catcttccttgatgttggag

SEQ ID NO: 1589 - DNA, 30 bp, synthetic construct
  misc_feature 1..30: note = Synthetic
  source 1..30: mol_type = other DNA
atcttccttgatgttggaggtacctgctct

SEQ ID NO: 1590 - DNA, 25 bp, synthetic construct
  misc_feature 1..25: note = Synthetic
  source 1..25: mol_type = other DNA
atcttccttgatgttggaggtacct

SEQ ID NO: 1591 - DNA, 21 bp, synthetic construct
  misc_feature 1..21: note = Synthetic
  source 1..21: mol_type = other DNA
atcttccttgatgttggaggt

SEQ ID NO: 1592 - DNA, 23 bp, synthetic construct
  misc_feature 1..23: note = Synthetic
  source 1..23: mol_type = other DNA
atcttccttgatgttggaggtac

SEQ ID NO: 1593 - DNA, 20 bp, synthetic construct
  misc_feature 1..20: note = Synthetic
  source 1..20: mol_type = other DNA
atcttccttgatgttggagg

SEQ ID NO: 1594 - DNA, 20 bp, synthetic construct
  misc_feature 1..20: note = Synthetic
  source 1..20: mol_type = other DNA
tcttccttgatgttggaggt

SEQ ID NO: 1595 - DNA, 30 bp, synthetic construct
  misc_feature 1..30: note = Synthetic
  source 1..30: mol_type = other DNA
tcttccttgatgttggaggtacctgctctg

SEQ ID NO: 1596 - DNA, 25 bp, synthetic construct
  misc_feature 1..25: note = Synthetic
  source 1..25: mol_type = other DNA
tcttccttgatgttggaggtacctg

SEQ ID NO: 1597 - DNA, 22 bp, synthetic construct
  misc_feature 1..22: note = Synthetic
  source 1..22: mol_type = other DNA
tcttccttgatgttggaggtac

SEQ ID NO: 1598 - DNA, 18 bp, synthetic construct
  misc_feature 1..18: note = Synthetic
  source 1..18: mol_type = other DNA
tcttccttgatgttggag

SEQ ID NO: 1599 - DNA, 20 bp, synthetic construct
  misc_feature 1..20: note = Synthetic
  source 1..20: mol_type = other DNA
cttccttgatgttggaggta

SEQ ID NO: 1600 - DNA, 30 bp, synthetic construct
  misc_feature 1..30: note = Synthetic
  source 1..30: mol_type = other DNA
cttccttgatgttggaggtacctgctctgg

SEQ ID NO: 1601 - DNA, 25 bp, synthetic construct
  misc_feature 1..25: note = Synthetic
  source 1..25: mol_type = other DNA
cttccttgatgttggaggtacctgc

SEQ ID NO: 1602 - DNA, 27 bp, synthetic construct
  misc_feature 1..27: note = Synthetic
  source 1..27: mol_type = other DNA
cttccttgatgttggaggtacctgctc

SEQ ID NO: 1603 - DNA, 29 bp, synthetic construct
  misc_feature 1..29: note = Synthetic
  source 1..29: mol_type = other DNA
cttccttgatgttggaggtacctgctctg

SEQ ID NO: 1604 - DNA, 21 bp, synthetic construct
  misc_feature 1..21: note = Synthetic
  source 1..21: mol_type = other DNA
cttccttgatgttggaggtac

SEQ ID NO: 1605 - DNA, 20 bp, synthetic construct
  misc_feature 1..20: note = Synthetic
  source 1..20: mol_type = other DNA
ttccttgatgttggaggtac

SEQ ID NO: 1606 - DNA, 30 bp, synthetic construct
  misc_feature 1..30: note = Synthetic
  source 1..30: mol_type = other DNA
ttccttgatgttggaggtacctgctctggc

SEQ ID NO: 1607 - DNA, 25 bp, synthetic construct
  misc_feature 1..25: note = Synthetic
  source 1..25: mol_type = other DNA
ttccttgatgttggaggtacctgct

SEQ ID NO: 1608 - DNA, 26 bp, synthetic construct
  misc_feature 1..26: note = Synthetic
  source 1..26: mol_type = other DNA
ttccttgatgttggaggtacctgctc

SEQ ID NO: 1609 - DNA, 20 bp, synthetic construct
  misc_feature 1..20: note = Synthetic
  source 1..20: mol_type = other DNA
tccttgatgttggaggtacc

SEQ ID NO: 1610 - DNA, 30 bp, synthetic construct
  misc_feature 1..30: note = Synthetic
  source 1..30: mol_type = other DNA
tccttgatgttggaggtacctgctctggca

SEQ ID NO: 1611 - DNA, 25 bp, synthetic construct
  misc_feature 1..25: note = Synthetic
  source 1..25: mol_type = other DNA
tccttgatgttggaggtacctgctc

SEQ ID NO: 1612 - DNA, 21 bp, synthetic construct
  misc_feature 1..21: note = Synthetic
  source 1..21: mol_type = other DNA
tccttgatgttggaggtacct

SEQ ID NO: 1613 - DNA, 20 bp, synthetic construct
  misc_feature 1..20: note = Synthetic
  source 1..20: mol_type = other DNA
ccttgatgttggaggtacct

SEQ ID NO: 1614 - DNA, 30 bp, synthetic construct
  misc_feature 1..30: note = Synthetic
  source 1..30: mol_type = other DNA
ccttgatgttggaggtacctgctctggcag

SEQ ID NO: 1615 - DNA, 25 bp, synthetic construct
  misc_feature 1..25: note = Synthetic
  source 1..25: mol_type = other DNA
ccttgatgttggaggtacctgctct

SEQ ID NO: 1616 - DNA, 22 bp, synthetic construct
  misc_feature 1..22: note = Synthetic
  source 1..22: mol_type = other DNA
ccttgatgttggaggtacctgc

SEQ ID NO: 1617 - DNA, 24 bp, synthetic construct
  misc_feature 1..24: note = Synthetic
  source 1..24: mol_type = other DNA
ccttgatgttggaggtacctgctc

SEQ ID NO: 1618 - DNA, 26 bp, synthetic construct
  misc_feature 1..26: note = Synthetic
  source 1..26: mol_type = other DNA
ccttgatgttggaggtacctgctctg

SEQ ID NO: 1619 - DNA, 28 bp, synthetic construct
  misc_feature 1..28: note = Synthetic
  source 1..28: mol_type = other DNA
ccttgatgttggaggtacctgctctggc

SEQ ID NO: 1620 - DNA, 20 bp, synthetic construct
  misc_feature 1..20: note = Synthetic
  source 1..20: mol_type = other DNA
cttgatgttggaggtacctg

SEQ ID NO: 1621 - DNA, 30 bp, synthetic construct
  misc_feature 1..30: note = Synthetic
  source 1..30: mol_type = other DNA
cttgatgttggaggtacctgctctggcaga

SEQ ID NO: 1622 - DNA, 25 bp, synthetic construct
  misc_feature 1..25: note = Synthetic
  source 1..25: mol_type = other DNA
cttgatgttggaggtacctgctctg

SEQ ID NO: 1623 - DNA, 29 bp, synthetic construct
  misc_feature 1..29: note = Synthetic
  source 1..29: mol_type = other DNA
cttgatgttggaggtacctgctctggcag

SEQ ID NO: 1624 - DNA, 23 bp, synthetic construct
  misc_feature 1..23: note = Synthetic
  source 1..23: mol_type = other DNA
cttgatgttggaggtacctgctc

SEQ ID NO: 1625 - DNA, 20 bp, synthetic construct
  misc_feature 1..20: note = Synthetic
  source 1..20: mol_type = other DNA
ttgatgttggaggtacctgc

SEQ ID NO: 1626 - DNA, 30 bp, synthetic construct
  misc_feature 1..30: note = Synthetic
  source 1..30: mol_type = other DNA
ttgatgttggaggtacctgctctggcagat

SEQ ID NO: 1627 - DNA, 25 bp, synthetic construct
  misc_feature 1..25: note = Synthetic
  source 1..25: mol_type = other DNA
ttgatgttggaggtacctgctctgg

SEQ ID NO: 1628 - DNA, 20 bp, synthetic construct
  misc_feature 1..20: note = Synthetic
  source 1..20: mol_type = other DNA
tgatgttggaggtacctgct

SEQ ID NO: 1629 - DNA, 30 bp, synthetic construct
  misc_feature 1..30: note = Synthetic
  source 1..30: mol_type = other DNA
tgatgttggaggtacctgctctggcagatt

SEQ ID NO: 1630 - DNA, 25 bp, synthetic construct
  misc_feature 1..25: note = Synthetic
  source 1..25: mol_type = other DNA
tgatgttggaggtacctgctctggc

SEQ ID NO: 1631 - DNA, 20 bp, synthetic construct
  misc_feature 1..20: note = Synthetic
  source 1..20: mol_type = other DNA
gatgttggaggtacctgctc

SEQ ID NO: 1632 - DNA, 30 bp, synthetic construct
  misc_feature 1..30: note = Synthetic
  source 1..30: mol_type = other DNA
gatgttggaggtacctgctctggcagattt

SEQ ID NO: 1633 - DNA, 23 bp, synthetic construct
  misc_feature 1..23: note = Synthetic
  source 1..23: mol_type = other DNA
gatgttggaggtacctgctctgg

SEQ ID NO: 1634 - DNA, 24 bp, synthetic construct
  misc_feature 1..24: note = Synthetic
  source 1..24: mol_type = other DNA
gatgttggaggtacctgctctggc

SEQ ID NO: 1635 - DNA, 25 bp, synthetic construct
  misc_feature 1..25: note = Synthetic
  source 1..25: mol_type = other DNA
gatgttggaggtacctgctctggca

SEQ ID NO: 1636 - DNA, 20 bp, synthetic construct
  misc_feature 1..20: note = Synthetic
  source 1..20: mol_type = other DNA
atgttggaggtacctgctct

SEQ ID NO: 1637 - DNA, 30 bp, synthetic construct
  misc_feature 1..30: note = Synthetic
  source 1..30: mol_type = other DNA
atgttggaggtacctgctctggcagatttc

SEQ ID NO: 1638 - DNA, 25 bp, synthetic construct
  misc_feature 1..25: note = Synthetic
  source 1..25: mol_type = other DNA
atgttggaggtacctgctctggcag

SEQ ID NO: 1639 - DNA, 20 bp, synthetic construct
  misc_feature 1..20: note = Synthetic
  source 1..20: mol_type = other DNA
tgttggaggtacctgctctg

SEQ ID NO: 1640 - DNA, 30 bp, synthetic construct
  misc_feature 1..30: note = Synthetic
  source 1..30: mol_type = other DNA
tgttggaggtacctgctctggcagatttca

SEQ ID NO: 1641 - DNA, 25 bp, synthetic construct
  misc_feature 1..25: note = Synthetic
  source 1..25: mol_type = other DNA
tgttggaggtacctgctctggcaga

SEQ ID NO: 1642 - DNA, 20 bp, synthetic construct
  misc_feature 1..20: note = Synthetic
  source 1..20: mol_type = other DNA
gttggaggtacctgctctgg

SEQ ID NO: 1643 - DNA, 30 bp, synthetic construct
  misc_feature 1..30: note = Synthetic
  source 1..30: mol_type = other DNA
gttggaggtacctgctctggcagatttcaa

SEQ ID NO: 1644 - DNA, 25 bp, synthetic construct
  misc_feature 1..25: note = Synthetic
  source 1..25: mol_type = other DNA
gttggaggtacctgctctggcagat

SEQ ID NO: 1645 - DNA, 20 bp, synthetic construct
  misc_feature 1..20: note = Synthetic
  source 1..20: mol_type = other DNA
ttggaggtacctgctctggc

SEQ ID NO: 1646 - DNA, 30 bp, synthetic construct
  misc_feature 1..30: note = Synthetic
  source 1..30: mol_type = other DNA
ttggaggtacctgctctggcagatttcaac

SEQ ID NO: 1647 - DNA, 27 bp, synthetic construct
  misc_feature 1..27: note = Synthetic
  source 1..27: mol_type = other DNA
ttggaggtacctgctctggcagatttc

SEQ ID NO: 1648 - DNA, 25 bp, synthetic construct
  misc_feature 1..25: note = Synthetic
  source 1..25: mol_type = other DNA
ttggaggtacctgctctggcagatt

SEQ ID NO: 1649 - DNA, 20 bp, synthetic construct
  misc_feature 1..20: note = Synthetic
  source 1..20: mol_type = other DNA
tggaggtacctgctctggca

SEQ ID NO: 1650 - DNA, 30 bp, synthetic construct
  misc_feature 1..30: note = Synthetic
  source 1..30: mol_type = other DNA
tggaggtacctgctctggcagatttcaacc

SEQ ID NO: 1651 - DNA, 21 bp, synthetic construct
  misc_feature 1..21: note = Synthetic
  source 1..21: mol_type = other DNA
tggaggtacctgctctggcag

SEQ ID NO: 1652 - DNA, 25 bp, synthetic construct
  misc_feature 1..25: note = Synthetic
  source 1..25: mol_type = other DNA
tggaggtacctgctctggcagattt

SEQ ID NO: 1653 - DNA, 18 bp, synthetic construct
  misc_feature 1..18: note = Synthetic
  source 1..18: mol_type = other DNA
tggaggtacctgctctgg

SEQ ID NO: 1654 - DNA, 20 bp, synthetic construct
  misc_feature 1..20: note = Synthetic
  source 1..20: mol_type = other DNA
ggaggtacctgctctggcag

SEQ ID NO: 1655 - DNA, 30 bp, synthetic construct
  misc_feature 1..30: note = Synthetic
  source 1..30: mol_type = other DNA
ggaggtacctgctctggcagatttcaaccg

SEQ ID NO: 1656 - DNA, 25 bp, synthetic construct
  misc_feature 1..25: note = Synthetic
  source 1..25: mol_type = other DNA
ggaggtacctgctctggcagatttc

SEQ ID NO: 1657 - DNA, 20 bp, synthetic construct
  misc_feature 1..20: note = Synthetic
  source 1..20: mol_type = other DNA
gaggtacctgctctggcaga

SEQ ID NO: 1658 - DNA, 30 bp, synthetic construct
  misc_feature 1..30: note = Synthetic
  source 1..30: mol_type = other DNA
gaggtacctgctctggcagatttcaaccgg

SEQ ID NO: 1659 - DNA, 25 bp, synthetic construct
  misc_feature 1..25: note = Synthetic
  source 1..25: mol_type = other DNA
gaggtacctgctctggcagatttca

SEQ ID NO: 1660 - DNA, 24 bp, synthetic construct
  misc_feature 1..24: note = Synthetic
  source 1..24: mol_type = other DNA
gaggtacctgctctggcagatttc

SEQ ID NO: 1661 - DNA, 20 bp, synthetic construct
  misc_feature 1..20: note = Synthetic
  source 1..20: mol_type = other DNA
aggtacctgctctggcagat

SEQ ID NO: 1662 - DNA, 30 bp, synthetic construct
  misc_feature 1..30: note = Synthetic
  source 1..30: mol_type = other DNA
aggtacctgctctggcagatttcaaccggg

SEQ ID NO: 1663 - DNA, 25 bp, synthetic construct
  misc_feature 1..25: note = Synthetic
  source 1..25: mol_type = other DNA
aggtacctgctctggcagatttcaa

SEQ ID NO: 1664 - DNA, 20 bp, synthetic construct
  misc_feature 1..20: note = Synthetic
  source 1..20: mol_type = other DNA
ggtacctgctctggcagatt

SEQ ID NO: 1665 - DNA, 30 bp, synthetic construct
  misc_feature 1..30: note = Synthetic
  source 1..30: mol_type = other DNA
ggtacctgctctggcagatttcaaccgggc

SEQ ID NO: 1666 - DNA, 25 bp, synthetic construct
  misc_feature 1..25: note = Synthetic
  source 1..25: mol_type = other DNA
ggtacctgctctggcagatttcaac

SEQ ID NO: 1667 - DNA, 30 bp, synthetic construct
  misc_feature 1..30: note = Synthetic
  source 1..30: mol_type = other DNA
gtacctgctctggcagatttcaaccgggct

SEQ ID NO: 1668 - DNA, 26 bp, synthetic construct
  misc_feature 1..26: note = Synthetic
  source 1..26: mol_type = other DNA
gtacctgctctggcagatttcaaccg

SEQ ID NO: 1669 - DNA, 25 bp, synthetic construct
  misc_feature 1..25: note = Synthetic
  source 1..25: mol_type = other DNA
gtacctgctctggcagatttcaacc

SEQ ID NO: 1670 - DNA, 30 bp, synthetic construct
  misc_feature 1..30: note = Synthetic
  source 1..30: mol_type = other DNA
tacctgctctggcagatttcaaccgggctt

SEQ ID NO: 1671 - DNA, 25 bp, synthetic construct
  misc_feature 1..25: note = Synthetic
  source 1..25: mol_type = other DNA
tacctgctctggcagatttcaaccg

SEQ ID NO: 1672 - DNA, 30 bp, synthetic construct
  misc_feature 1..30: note = Synthetic
  source 1..30: mol_type = other DNA
acctgctctggcagatttcaaccgggcttg

SEQ ID NO: 1673 - DNA, 25 bp, synthetic construct
  misc_feature 1..25: note = Synthetic
  source 1..25: mol_type = other DNA
acctgctctggcagatttcaaccgg

SEQ ID NO: 1674 - DNA, 20 bp, synthetic construct
  misc_feature 1..20: note = Synthetic
  source 1..20: mol_type = other DNA
cctgctctggcagatttcaa

SEQ ID NO: 1675 - DNA, 30 bp, synthetic construct
  misc_feature 1..30: note = Synthetic
  source 1..30: mol_type = other DNA
cctgctctggcagatttcaaccgggcttgg

SEQ ID NO: 1676 - DNA, 25 bp, synthetic construct
  misc_feature 1..25: note = Synthetic
  source 1..25: mol_type = other DNA
cctgctctggcagatttcaaccggg

SEQ ID NO: 1677 - DNA, 20 bp, synthetic construct
  misc_feature 1..20: note = Synthetic
  source 1..20: mol_type = other DNA
ctgctctggcagatttcaac

SEQ ID NO: 1678 - DNA, 30 bp, synthetic construct
  misc_feature 1..30: note = Synthetic
  source 1..30: mol_type = other DNA
ctgctctggcagatttcaaccgggcttgga

SEQ ID NO: 1679 - DNA, 25 bp, synthetic construct
  misc_feature 1..25: note = Synthetic
  source 1..25: mol_type = other DNA
ctgctctggcagatttcaaccgggc

SEQ ID NO: 1680 - DNA, 20 bp, synthetic construct
  misc_feature 1..20: note = Synthetic
  source 1..20: mol_type = other DNA
tgctctggcagatttcaacc

SEQ ID NO: 1681 - DNA, 30 bp, synthetic construct
  misc_feature 1..30: note = Synthetic
  source 1..30: mol_type = other DNA
tgctctggcagatttcaaccgggcttggac

SEQ ID NO: 1682 - DNA, 21 bp, synthetic construct
  misc_feature 1..21: note = Synthetic
  source 1..21: mol_type = other DNA
tgctctggcagatttcaaccg

SEQ ID NO: 1683 - DNA, 25 bp, synthetic construct
  misc_feature 1..25: note = Synthetic
  source 1..25: mol_type = other DNA
tgctctggcagatttcaaccgggct

SEQ ID NO: 1684 - DNA, 20 bp, synthetic construct
  misc_feature 1..20: note = Synthetic
  source 1..20: mol_type = other DNA
gctctggcagatttcaaccg

SEQ ID NO: 1685 - DNA, 30 bp, synthetic construct
  misc_feature 1..30: note = Synthetic
  source 1..30: mol_type = other DNA
gctctggcagatttcaaccgggcttggaca

SEQ ID NO: 1686 - DNA, 25 bp, synthetic construct
  misc_feature 1..25: note = Synthetic
  source 1..25: mol_type = other DNA
gctctggcagatttcaaccgggctt

SEQ ID NO: 1687 - DNA, 20 bp, synthetic construct
  misc_feature 1..20: note = Synthetic
  source 1..20: mol_type = other DNA
ctctggcagatttcaaccgg

SEQ ID NO: 1688 - DNA, 30 bp, synthetic construct
  misc_feature 1..30: note = Synthetic
  source 1..30: mol_type = other DNA
ctctggcagatttcaaccgggcttggacag

SEQ ID NO: 1689 - DNA, 35 bp, synthetic construct
  misc_feature 1..35: note = Synthetic
  source 1..35: mol_type = other DNA
ctctggcagatttcaaccgggcttggacagaactt

SEQ ID NO: 1690 - DNA, 29 bp, synthetic construct
  misc_feature 1..29: note = Synthetic
  source 1..29: mol_type = other DNA
ctctggcagatttcaaccgggcttggaca

SEQ ID NO: 1691 - DNA, 25 bp, synthetic construct
  misc_feature 1..25: note = Synthetic
  source 1..25: mol_type = other DNA
ctctggcagatttcaaccgggcttg

SEQ ID NO: 1692 - DNA, 20 bp, synthetic construct
  misc_feature 1..20: note = Synthetic
  source 1..20: mol_type = other DNA
tctggcagatttcaaccggg

SEQ ID NO: 1693 - DNA, 30 bp, synthetic construct
  misc_feature 1..30: note = Synthetic
  source 1..30: mol_type = other DNA
tctggcagatttcaaccgggcttggacaga

SEQ ID NO: 1694 - DNA, 25 bp, synthetic construct
  misc_feature 1..25: note = Synthetic
  source 1..25: mol_type = other DNA
tctggcagatttcaaccgggcttgg

SEQ ID NO: 1695 - DNA, 20 bp, synthetic construct
  misc_feature 1..20: note = Synthetic
  source 1..20: mol_type = other DNA
ctggcagatttcaaccgggc

SEQ ID NO: 1696 - DNA, 30 bp, synthetic construct
  misc_feature 1..30: note = Synthetic
  source 1..30: mol_type = other DNA
ctggcagatttcaaccgggcttggacagaa

SEQ ID NO: 1697 - DNA, 25 bp, synthetic construct
  misc_feature 1..25: note = Synthetic
  source 1..25: mol_type = other DNA
ctggcagatttcaaccgggcttgga

SEQ ID NO: 1698 - DNA, 20 bp, synthetic construct
  misc_feature 1..20: note = Synthetic
  source 1..20: mol_type = other DNA
tggcagatttcaaccgggct

SEQ ID NO: 1699 - DNA, 30 bp, synthetic construct
  misc_feature 1..30: note = Synthetic
  source 1..30: mol_type = other DNA
tggcagatttcaaccgggcttggacagaac

SEQ ID NO: 1700 - DNA, 25 bp, synthetic construct
  misc_feature 1..25: note = Synthetic
  source 1..25: mol_type = other DNA
tggcagatttcaaccgggcttggac

SEQ ID NO: 1701 - DNA, 20 bp, synthetic construct
  misc_feature 1..20: note = Synthetic
  source 1..20: mol_type = other DNA
ggcagatttcaaccgggctt

SEQ ID NO: 1702 - DNA, 30 bp, synthetic construct
  misc_feature 1..30: note = Synthetic
  source 1..30: mol_type = other DNA
ggcagatttcaaccgggcttggacagaact

SEQ ID NO: 1703 - DNA, 25 bp, synthetic construct
  misc_feature 1..25: note = Synthetic
  source 1..25: mol_type = other DNA
ggcagatttcaaccgggcttggaca

SEQ ID NO: 1704 - DNA, 20 bp, synthetic construct
  misc_feature 1..20: note = Synthetic
  source 1..20: mol_type = other DNA
gcagatttcaaccgggcttg

SEQ ID NO: 1705 - DNA, 30 bp, synthetic construct
  misc_feature 1..30: note = Synthetic
  source 1..30: mol_type = other DNA
gcagatttcaaccgggcttggacagaactt

SEQ ID NO: 1706 - DNA, 25 bp, synthetic construct
  misc_feature 1..25: note = Synthetic
  source 1..25: mol_type = other DNA
gcagatttcaaccgggcttggacag

SEQ ID NO: 1707 - DNA, 20 bp, synthetic construct
  misc_feature 1..20: note = Synthetic
  source 1..20: mol_type = other DNA
cagatttcaaccgggcttgg

SEQ ID NO: 1708 - DNA, 30 bp, synthetic construct
  misc_feature 1..30: note = Synthetic
  source 1..30: mol_type = other DNA
cagatttcaaccgggcttggacagaactta

SEQ ID NO: 1709 - DNA, 25 bp, synthetic construct
  misc_feature 1..25: note = Synthetic
  source 1..25: mol_type = other DNA
cagatttcaaccgggcttggacaga

SEQ ID NO: 1710 - DNA, 20 bp, synthetic construct
  misc_feature 1..20: note = Synthetic
  source 1..20: mol_type = other DNA
agatttcaaccgggcttgga

SEQ ID NO: 1711 - DNA, 30 bp, synthetic construct
  misc_feature 1..30: note = Synthetic
  source 1..30: mol_type = other DNA
agatttcaaccgggcttggacagaacttac

SEQ ID NO: 1712 - DNA, 25 bp, synthetic construct
  misc_feature 1..25: note = Synthetic
  source 1..25: mol_type = other DNA
agatttcaaccgggcttggacagaa

SEQ ID NO: 1713 - DNA, 33 bp, synthetic construct
  misc_feature 1..33: note = Synthetic
  source 1..33: mol_type = other DNA
agatttcaaccgggcttggacagaacttaccga

SEQ ID NO: 1714 - DNA, 20 bp, synthetic construct
  misc_feature 1..20: note = Synthetic
  source 1..20: mol_type = other DNA
gatttcaaccgggcttggac

SEQ ID NO: 1715 - DNA, 30 bp, synthetic construct
  misc_feature 1..30: note = Synthetic
  source 1..30: mol_type = other DNA
gatttcaaccgggcttggacagaacttacc

SEQ ID NO: 1716 - DNA, 24 bp, synthetic construct
  misc_feature 1..24: note = Synthetic
  source 1..24: mol_type = other DNA
gatttcaaccgggcttggacagaa

SEQ ID NO: 1717 - DNA, 21 bp, synthetic construct
  misc_feature 1..21: note = Synthetic
  source 1..21: mol_type = other DNA
gatttcaaccgggcttggaca

SEQ ID NO: 1718 - DNA, 25 bp, synthetic construct
  misc_feature 1..25: note = Synthetic
  source 1..25: mol_type = other DNA
gatttcaaccgggcttggacagaac

SEQ ID NO: 1719 - DNA, 20 bp, synthetic construct
  misc_feature 1..20: note = Synthetic
  source 1..20: mol_type = other DNA
atttcaaccgggcttggaca

SEQ ID NO: 1720 - DNA, 30 bp, synthetic construct
  misc_feature 1..30: note = Synthetic
  source 1..30: mol_type = other DNA
atttcaaccgggcttggacagaacttaccg

SEQ ID NO: 1721 - DNA, 25 bp, synthetic construct
  misc_feature 1..25: note = Synthetic
  source 1..25: mol_type = other DNA
atttcaaccgggcttggacagaact

SEQ ID NO: 1722 - DNA, 26 bp, synthetic construct
  misc_feature 1..26: note = Synthetic
  source 1..26: mol_type = other DNA
atttcaaccgggcttggacagaactt

SEQ ID NO: 1723 - DNA, 20 bp, synthetic construct
  misc_feature 1..20: note = Synthetic
  source 1..20: mol_type = other DNA
tttcaaccgggcttggacag

SEQ ID NO: 1724 - DNA, 30 bp, synthetic construct
  misc_feature 1..30: note = Synthetic
  source 1..30: mol_type = other DNA
tttcaaccgggcttggacagaacttaccga

SEQ ID NO: 1725 - DNA, 25 bp, synthetic construct
  misc_feature 1..25: note = Synthetic
  source 1..25: mol_type = other DNA
tttcaaccgggcttggacagaactt

SEQ ID NO: 1726 - DNA, 20 bp, synthetic construct
  misc_feature 1..20: note = Synthetic
  source 1..20: mol_type = other DNA
ttcaaccgggcttggacaga

SEQ ID NO: 1727 - DNA, 30 bp, synthetic construct
  misc_feature 1..30: note = Synthetic
  source 1..30: mol_type = other DNA
ttcaaccgggcttggacagaacttaccgac

SEQ ID NO: 1728 - DNA, 25 bp, synthetic construct
  misc_feature 1..25: note = Synthetic
  source 1..25: mol_type = other DNA
ttcaaccgggcttggacagaactta

SEQ ID NO: 1729 - DNA, 20 bp, synthetic construct
  misc_feature 1..20: note = Synthetic
  source 1..20: mol_type = other DNA
tcaaccgggcttggacagaa

SEQ ID NO: 1730 - DNA, 30 bp, synthetic construct
  misc_feature 1..30: note = Synthetic
  source 1..30: mol_type = other DNA
tcaaccgggcttggacagaacttaccgact

SEQ ID NO: 1731 - DNA, 25 bp, synthetic construct
  misc_feature 1..25: note = Synthetic
  source 1..25: mol_type = other DNA
tcaaccgggcttggacagaacttac

SEQ ID NO: 1732 - DNA, 20 bp, synthetic construct
  misc_feature 1..20: note = Synthetic
  source 1..20: mol_type = other DNA
caaccgggcttggacagaac

SEQ ID NO: 1733 - DNA, 30 bp, synthetic construct
  misc_feature 1..30: note = Synthetic
  source 1..30: mol_type = other DNA
caaccgggcttggacagaacttaccgactg

SEQ ID NO: 1734 - DNA, 25 bp, synthetic construct
  misc_feature 1..25: note = Synthetic
  source 1..25: mol_type = other DNA
caaccgggcttggacagaacttacc

SEQ ID NO: 1735 - DNA, 22 bp, synthetic construct
  misc_feature 1..22: note = Synthetic
  source 1..22: mol_type = other DNA
caaccgggcttggacagaactt

SEQ ID NO: 1736 - DNA, 20 bp, synthetic construct
  misc_feature 1..20: note = Synthetic
  source 1..20: mol_type = other DNA
aaccgggcttggacagaact

SEQ ID NO: 1737 - DNA, 30 bp, synthetic construct
  misc_feature 1..30: note = Synthetic
  source 1..30: mol_type = other DNA
aaccgggcttggacagaacttaccgactgg

SEQ ID NO: 1738 - DNA, 25 bp, synthetic construct
  misc_feature 1..25: note = Synthetic
  source 1..25: mol_type = other DNA
aaccgggcttggacagaacttaccg

SEQ ID NO: 1739 - DNA, 24 bp, synthetic construct
  misc_feature 1..24: note = Synthetic
  source 1..24: mol_type = other DNA
aaccgggcttggacagaacttacc

SEQ ID NO: 1740 - DNA, 20 bp, synthetic construct
  misc_feature 1..20: note = Synthetic
  source 1..20: mol_type = other DNA
accgggcttggacagaactt

SEQ ID NO: 1741 - DNA, 30 bp, synthetic construct
  misc_feature 1..30: note = Synthetic
  source 1..30: mol_type = other DNA
accgggcttggacagaacttaccgactggc

SEQ ID NO: 1742 - DNA, 25 bp, synthetic construct
  misc_feature 1..25: note = Synthetic
  source 1..25: mol_type = other DNA
accgggcttggacagaacttaccga

SEQ ID NO: 1743 - DNA, 20 bp, synthetic construct
  misc_feature 1..20: note = Synthetic
  source 1..20: mol_type = other DNA
ccgggcttggacagaactta

SEQ ID NO: 1744 - DNA, 30 bp, synthetic construct
  misc_feature 1..30: note = Synthetic
  source 1..30: mol_type = other DNA
ccgggcttggacagaacttaccgactggct

SEQ ID NO: 1745 - DNA, 25 bp, synthetic construct
  misc_feature 1..25: note = Synthetic
  source 1..25: mol_type = other DNA
ccgggcttggacagaacttaccgac

SEQ ID NO: 1746 - DNA, 20 bp, synthetic construct
  misc_feature 1..20: note = Synthetic
  source 1..20: mol_type = other DNA
cgggcttggacagaacttac

SEQ ID NO: 1747 - DNA, 30 bp, synthetic construct
  misc_feature 1..30: note = Synthetic
  source 1..30: mol_type = other DNA
cgggcttggacagaacttaccgactggctt

SEQ ID NO: 1748 - DNA, 25 bp, synthetic construct
  misc_feature 1..25: note = Synthetic
  source 1..25: mol_type = other DNA
cgggcttggacagaacttaccgact

SEQ ID NO: 1749 - DNA, 20 bp, synthetic construct
  misc_feature 1..20: note = Synthetic
  source 1..20: mol_type = other DNA
gggcttggacagaacttacc

SEQ ID NO: 1750 - DNA, 30 bp, synthetic construct
  misc_feature 1..30: note = Synthetic
  source 1..30: mol_type = other DNA
gggcttggacagaacttaccgactggcttt

SEQ ID NO: 1751 - DNA, 21 bp, synthetic construct
  misc_feature 1..21: note = Synthetic
  source 1..21: mol_type = other DNA
gggcttggacagaacttaccg

SEQ ID NO: 1752 - DNA, 25 bp, synthetic construct
  misc_feature 1..25: note = Synthetic
  source 1..25: mol_type = other DNA
gggcttggacagaacttaccgactg

SEQ ID NO: 1753 - DNA, 20 bp, synthetic construct
  misc_feature 1..20: note = Synthetic
  source 1..20: mol_type = other DNA
ggcttggacagaacttaccg

SEQ ID NO: 1754 - DNA, 30 bp, synthetic construct
  misc_feature 1..30: note = Synthetic
  source 1..30: mol_type = other DNA
ggcttggacagaacttaccgactggctttc

SEQ ID NO: 1755 - DNA, 25 bp, synthetic construct
  misc_feature 1..25: note = Synthetic
  source 1..25: mol_type = other DNA
ggcttggacagaacttaccgactgg

SEQ ID NO: 1756 - DNA, 20 bp, synthetic construct
  misc_feature 1..20: note = Synthetic
  source 1..20: mol_type = other DNA
gcttggacagaacttaccga

SEQ ID NO: 1757 - DNA, 30 bp, synthetic construct
  misc_feature 1..30: note = Synthetic
  source 1..30: mol_type = other DNA
gcttggacagaacttaccgactggctttct

SEQ ID NO: 1758 - DNA, 18 bp, synthetic construct
  misc_feature 1..18: note = Synthetic
  source 1..18: mol_type = other DNA
gcttggacagaacttacc

SEQ ID NO: 1759 - DNA, 25 bp, synthetic construct
  misc_feature 1..25: note = Synthetic
  source 1..25: mol_type = other DNA
gcttggacagaacttaccgactggc

SEQ ID NO: 1760 - DNA, 20 bp, synthetic construct
  misc_feature 1..20: note = Synthetic
  source 1..20: mol_type = other DNA
cttggacagaacttaccgac

SEQ ID NO: 1761 - DNA, 30 bp, synthetic construct
  misc_feature 1..30: note = Synthetic
  source 1..30: mol_type = other DNA
cttggacagaacttaccgactggctttctc

SEQ ID NO: 1762 - DNA, 23 bp, synthetic construct
  misc_feature 1..23: note = Synthetic
  source 1..23: mol_type = other DNA
cttggacagaacttaccgactgg

SEQ ID NO: 1763 - DNA, 25 bp, synthetic construct
  misc_feature 1..25: note = Synthetic
  source 1..25: mol_type = other DNA
cttggacagaacttaccgactggct

SEQ ID NO: 1764 - DNA, 20 bp, synthetic construct
  misc_feature 1..20: note = Synthetic
  source 1..20: mol_type = other DNA
ttggacagaacttaccgact

SEQ ID NO: 1765 - DNA, 30 bp, synthetic construct
  misc_feature 1..30: note = Synthetic
  source 1..30: mol_type = other DNA
ttggacagaacttaccgactggctttctct

SEQ ID NO: 1766 - DNA, 25 bp, synthetic construct
  misc_feature 1..25: note = Synthetic
  source 1..25: mol_type = other DNA
ttggacagaacttaccgactggctt

SEQ ID NO: 1767 - DNA, 19 bp, synthetic construct
  misc_feature 1..19: note = Synthetic
  source 1..19: mol_type = other DNA
ttggacagaacttaccgac

SEQ ID NO: 1768 - DNA, 20 bp, synthetic construct
  misc_feature 1..20: note = Synthetic
  source 1..20: mol_type = other DNA
tggacagaacttaccgactg

SEQ ID NO: 1769 - DNA, 30 bp, synthetic construct
  misc_feature 1..30: note = Synthetic
  source 1..30: mol_type = other DNA
tggacagaacttaccgactggctttctctg

SEQ ID NO: 1770 - DNA, 25 bp, synthetic construct
  misc_feature 1..25: note = Synthetic
  source 1..25: mol_type = other DNA
tggacagaacttaccgactggcttt

SEQ ID NO: 1771 - DNA, 21 bp, synthetic construct
  misc_feature 1..21: note = Synthetic
  source 1..21: mol_type = other DNA
tggacagaacttaccgactgg

SEQ ID NO: 1772 - DNA, 20 bp, synthetic construct
  misc_feature 1..20: note = Synthetic
  source 1..20: mol_type = other DNA
ggacagaacttaccgactgg

SEQ ID NO: 1773 - DNA, 30 bp, synthetic construct
  misc_feature 1..30: note = Synthetic
  source 1..30: mol_type = other DNA
ggacagaacttaccgactggctttctctgc

SEQ ID NO: 1774 - DNA, 25 bp, synthetic construct
  misc_feature 1..25: note = Synthetic
  source 1..25: mol_type = other DNA
ggacagaacttaccgactggctttc

SEQ ID NO: 1775 - DNA, 20 bp, synthetic construct
  misc_feature 1..20: note = Synthetic
  source 1..20: mol_type = other DNA
gacagaacttaccgactggc

SEQ ID NO: 1776 - DNA, 30 bp, synthetic construct
  misc_feature 1..30: note = Synthetic
  source 1..30: mol_type = other DNA
gacagaacttaccgactggctttctctgct

SEQ ID NO: 1777 - DNA, 26 bp, synthetic construct
  misc_feature 1..26: note = Synthetic
  source 1..26: mol_type = other DNA
gacagaacttaccgactggctttctc

SEQ ID NO: 1778 - DNA, 25 bp, synthetic construct
  misc_feature 1..25: note = Synthetic
  source 1..25: mol_type = other DNA
gacagaacttaccgactggctttct

SEQ ID NO: 1779 - DNA, 20 bp, synthetic construct
  misc_feature 1..20: note = Synthetic
  source 1..20: mol_type = other DNA
acagaacttaccgactggct

SEQ ID NO: 1780 - DNA, 30 bp, synthetic construct
  misc_feature 1..30: note = Synthetic
  source 1..30: mol_type = other DNA
acagaacttaccgactggctttctctgctt

SEQ ID NO: 1781 - DNA, 25 bp, synthetic construct
  misc_feature 1..25: note = Synthetic
  source 1..25: mol_type = other DNA
acagaacttaccgactggctttctc

SEQ ID NO: 1782 - DNA, 20 bp, synthetic construct
  misc_feature 1..20: note = Synthetic
  source 1..20: mol_type = other DNA
cagaacttaccgactggctt

SEQ ID NO: 1783 - DNA, 30 bp, synthetic construct
  misc_feature 1..30: note = Synthetic
  source 1..30: mol_type = other DNA
cagaacttaccgactggctttctctgcttg

SEQ ID NO: 1784 - DNA, 25 bp, synthetic construct
  misc_feature 1..25: note = Synthetic
  source 1..25: mol_type = other DNA
cagaacttaccgactggctttctct

SEQ ID NO: 1785 - DNA, 20 bp, synthetic construct
  misc_feature 1..20: note = Synthetic
  source 1..20: mol_type = other DNA
agaacttaccgactggcttt

SEQ ID NO: 1786 - DNA, 30 bp, synthetic construct
  misc_feature 1..30: note = Synthetic
  source 1..30: mol_type = other DNA
agaacttaccgactggctttctctgcttga

SEQ ID NO: 1787 - DNA, 18 bp, synthetic construct
  misc_feature 1..18: note = Synthetic
  source 1..18: mol_type = other DNA
agaacttaccgactggct

SEQ ID NO: 1788 - DNA, 21 bp, synthetic construct
  misc_feature 1..21: note = Synthetic
  source 1..21: mol_type = other DNA
agaacttaccgactggctttc

SEQ ID NO: 1789 - DNA, 25 bp, synthetic construct
  misc_feature 1..25: note = Synthetic
  source 1..25: mol_type = other DNA
agaacttaccgactggctttctctg

SEQ ID NO: 1790 - DNA, 20 bp, synthetic construct
  misc_feature 1..20: note = Synthetic
  source 1..20: mol_type = other DNA
gaacttaccgactggctttc

SEQ ID NO: 1791 - DNA, 30 bp, synthetic construct
  misc_feature 1..30: note = Synthetic
  source 1..30: mol_type = other DNA
gaacttaccgactggctttctctgcttgat

SEQ ID NO: 1792 - DNA, 23 bp, synthetic construct
  misc_feature 1..23: note = Synthetic
  source 1..23: mol_type = other DNA
gaacttaccgactggctttctct

SEQ ID NO: 1793 - DNA, 25 bp, synthetic construct
  misc_feature 1..25: note = Synthetic
  source 1..25: mol_type = other DNA
gaacttaccgactggctttctctgc

SEQ ID NO: 1794 - DNA, 20 bp, synthetic construct
  misc_feature 1..20: note = Synthetic
  source 1..20: mol_type = other DNA
aacttaccgactggctttct

SEQ ID NO: 1795 - DNA, 30 bp, synthetic construct
  misc_feature 1..30: note = Synthetic
  source 1..30: mol_type = other DNA
aacttaccgactggctttctctgcttgatc

SEQ ID NO: 1796 - DNA, 25 bp, synthetic construct
  misc_feature 1..25: note = Synthetic
  source 1..25: mol_type = other DNA
aacttaccgactggctttctctgct

SEQ ID NO: 1797 - DNA, 20 bp, synthetic construct
  misc_feature 1..20: note = Synthetic
  source 1..20: mol_type = other DNA
acttaccgactggctttctc

SEQ ID NO: 1798 - DNA, 30 bp, synthetic construct
  misc_feature 1..30: note = Synthetic
  source 1..30: mol_type = other DNA
acttaccgactggctttctctgcttgatca

SEQ ID NO: 1799 - DNA, 25 bp, synthetic construct
  misc_feature 1..25: note = Synthetic
  source 1..25: mol_type = other DNA
acttaccgactggctttctctgctt

SEQ ID NO: 1800 - DNA, 20 bp, synthetic construct
  misc_feature 1..20: note = Synthetic
  source 1..20: mol_type = other DNA
cttaccgactggctttctct

SEQ ID NO: 1801 - DNA, 30 bp, synthetic construct
  misc_feature 1..30: note = Synthetic
  source 1..30: mol_type = other DNA
cttaccgactggctttctctgcttgatcaa

SEQ ID NO: 1802 - DNA, 25 bp, synthetic construct
  misc_feature 1..25: note = Synthetic
  source 1..25: mol_type = other DNA
cttaccgactggctttctctgcttg

SEQ ID NO: 1803 - DNA, 20 bp, synthetic construct
  misc_feature 1..20: note = Synthetic
  source 1..20: mol_type = other DNA
ttaccgactggctttctctg

SEQ ID NO: 1804 - DNA, 30 bp, synthetic construct
  misc_feature 1..30: note = Synthetic
  source 1..30: mol_type = other DNA
ttaccgactggctttctctgcttgatcaag

SEQ ID NO: 1805 - DNA, 25 bp, synthetic construct
  misc_feature 1..25: note = Synthetic
  source 1..25: mol_type = other DNA
ttaccgactggctttctctgcttga

SEQ ID NO: 1806 - DNA, 21 bp, synthetic construct
  misc_feature 1..21: note = Synthetic
  source 1..21: mol_type = other DNA
ttaccgactggctttctctgc

SEQ ID NO: 1807 - DNA, 20 bp, synthetic construct
  misc_feature 1..20: note = Synthetic
  source 1..20: mol_type = other DNA
taccgactggctttctctgc

SEQ ID NO: 1808 - DNA, 30 bp, synthetic construct
  misc_feature 1..30: note = Synthetic
  source 1..30: mol_type = other DNA
taccgactggctttctctgcttgatcaagt

SEQ ID NO: 1809 - DNA, 25 bp, synthetic construct
  misc_feature 1..25: note = Synthetic
  source 1..25: mol_type = other DNA
taccgactggctttctctgcttgat

SEQ ID NO: 1810 - DNA, 20 bp, synthetic construct
  misc_feature 1..20: note = Synthetic
  source 1..20: mol_type = other DNA
accgactggctttctctgct

SEQ ID NO: 1811 - DNA, 30 bp, synthetic construct
  misc_feature 1..30: note = Synthetic
  source 1..30: mol_type = other DNA
accgactggctttctctgcttgatcaagtt

SEQ ID NO: 1812 - DNA, 25 bp, synthetic construct
  misc_feature 1..25: note = Synthetic
  source 1..25: mol_type = other DNA
accgactggctttctctgcttgatc

SEQ ID NO: 1813 - DNA, 20 bp, synthetic construct
  misc_feature 1..20: note = Synthetic
  source 1..20: mol_type = other DNA
ccgactggctttctctgctt

SEQ ID NO: 1814 - DNA, 30 bp, synthetic construct
  misc_feature 1..30: note = Synthetic
  source 1..30: mol_type = other DNA
ccgactggctttctctgcttgatcaagtta

SEQ ID NO: 1815 - DNA, 45 bp, synthetic construct
  misc_feature 1..45: note = Synthetic
  source 1..45: mol_type = other DNA
ccgactggctttctctgcttgatcaagttataaaatcacagaggg

SEQ ID NO: 1816 - DNA, 25 bp, synthetic construct
  misc_feature 1..25: note = Synthetic
  source 1..25: mol_type = other DNA
ccgactggctttctctgcttgatca

SEQ ID NO: 1817 - DNA, 20 bp, synthetic construct
  misc_feature 1..20: note = Synthetic
  source 1..20: mol_type = other DNA
cgactggctttctctgcttg

SEQ ID NO: 1818 - DNA, 30 bp, synthetic construct
  misc_feature 1..30: note = Synthetic
  source 1..30: mol_type = other DNA
cgactggctttctctgcttgatcaagttat

SEQ ID NO: 1819 - DNA, 25 bp, synthetic construct
  misc_feature 1..25: note = Synthetic
  source 1..25: mol_type = other DNA
cgactggctttctctgcttgatcaa

SEQ ID NO: 1820 - DNA, 20 bp, synthetic construct
  misc_feature 1..20: note = Synthetic
  source 1..20: mol_type = other DNA
gactggctttctctgcttga

SEQ ID NO: 1821 - DNA, 30 bp, synthetic construct
  misc_feature 1..30: note = Synthetic
  source 1..30: mol_type = other DNA
gactggctttctctgcttgatcaagttata

SEQ ID NO: 1822 - DNA, 25 bp, synthetic construct
  misc_feature 1..25: note = Synthetic
  source 1..25: mol_type = other DNA
gactggctttctctgcttgatcaag

SEQ ID NO: 1823 - DNA, 21 bp, synthetic construct
  misc_feature 1..21: note = Synthetic
  source 1..21: mol_type = other DNA
gactggctttctctgcttgat

SEQ ID NO: 1824 - DNA, 20 bp, synthetic construct
  misc_feature 1..20: note = Synthetic
  source 1..20: mol_type = other DNA
actggctttctctgcttgat

SEQ ID NO: 1825 - DNA, 30 bp, synthetic construct
  misc_feature 1..30: note = Synthetic
  source 1..30: mol_type = other DNA
actggctttctctgcttgatcaagttataa

SEQ ID NO: 1826 - DNA, 25 bp, synthetic construct
  misc_feature 1..25: note = Synthetic
  source 1..25: mol_type = other DNA
actggctttctctgcttgatcaagt

SEQ ID NO: 1827 - DNA, 20 bp, synthetic construct
  misc_feature 1..20: note = Synthetic
  source 1..20: mol_type = other DNA
ctggctttctctgcttgatc

SEQ ID NO: 1828 - DNA, 30 bp, synthetic construct
  misc_feature 1..30: note = Synthetic
  source 1..30: mol_type = other DNA
ctggctttctctgcttgatcaagttataaa

SEQ ID NO: 1829 - DNA, 23 bp, synthetic construct
  misc_feature 1..23: note = Synthetic
  source 1..23: mol_type = other DNA
ctggctttctctgcttgatcaag

SEQ ID NO: 1830 - DNA, 25 bp, synthetic construct
  misc_feature 1..25: note = Synthetic
  source 1..25: mol_type = other DNA
ctggctttctctgcttgatcaagtt

SEQ ID NO: 1831 - DNA, 20 bp, synthetic construct
  misc_feature 1..20: note = Synthetic
  source 1..20: mol_type = other DNA
tggctttctctgcttgatca

SEQ ID NO: 1832 - DNA, 30 bp, synthetic construct
  misc_feature 1..30: note = Synthetic
  source 1..30: mol_type = other DNA
tggctttctctgcttgatcaagttataaaa

SEQ ID NO: 1833 - DNA, 26 bp, synthetic construct
  misc_feature 1..26: note = Synthetic
  source 1..26: mol_type = other DNA
tggctttctctgcttgatcaagttat

SEQ ID NO: 1834 - DNA, 25 bp, synthetic construct
  misc_feature 1..25: note = Synthetic
  source 1..25: mol_type = other DNA
tggctttctctgcttgatcaagtta

SEQ ID NO: 1835 - DNA, 20 bp, synthetic construct
  misc_feature 1..20: note = Synthetic
  source 1..20: mol_type = other DNA
ggctttctctgcttgatcaa

SEQ ID NO: 1836 - DNA, 30 bp, synthetic construct
  misc_feature 1..30: note = Synthetic
  source 1..30: mol_type = other DNA
ggctttctctgcttgatcaagttataaaat

SEQ ID NO: 1837 - DNA, 25 bp, synthetic construct
  misc_feature 1..25: note = Synthetic
  source 1..25: mol_type = other DNA
ggctttctctgcttgatcaagttat

SEQ ID NO: 1838 - DNA, 20 bp, synthetic construct
  misc_feature 1..20: note = Synthetic
  source 1..20: mol_type = other DNA
gctttctctgcttgatcaag

SEQ ID NO: 1839 - DNA, 30 bp, synthetic construct
  misc_feature 1..30: note = Synthetic
  source 1..30: mol_type = other DNA
gctttctctgcttgatcaagttataaaatc

SEQ ID NO: 1840 - DNA, 25 bp, synthetic construct
  misc_feature 1..25: note = Synthetic
  source 1..25: mol_type = other DNA
gctttctctgcttgatcaagttata

SEQ ID NO: 1841 - DNA, 20 bp, synthetic construct
  misc_feature 1..20: note = Synthetic
  source 1..20: mol_type = other DNA
ctttctctgcttgatcaagt

SEQ ID NO: 1842 - DNA, 30 bp, synthetic construct
  misc_feature 1..30: note = Synthetic
  source 1..30: mol_type = other DNA
ctttctctgcttgatcaagttataaaatca

SEQ ID NO: 1843 - DNA, 25 bp, synthetic construct
  misc_feature 1..25: note = Synthetic
  source 1..25: mol_type = other DNA
ctttctctgcttgatcaagttataa

SEQ ID NO: 1844 - DNA, 20 bp, synthetic construct
  misc_feature 1..20: note = Synthetic
  source 1..20: mol_type = other DNA
tttctctgcttgatcaagtt

SEQ ID NO: 1845 - DNA, 30 bp, synthetic construct
  misc_feature 1..30: note = Synthetic
  source 1..30: mol_type = other DNA
tttctctgcttgatcaagttataaaatcac

SEQ ID NO: 1846 - DNA, 25 bp, synthetic construct
  misc_feature 1..25: note = Synthetic
  source 1..25: mol_type = other DNA
tttctctgcttgatcaagttataaa

SEQ ID NO: 1847 - DNA, 20 bp, synthetic construct
  misc_feature 1..20: note = Synthetic
  source 1..20: mol_type = other DNA
ttctctgcttgatcaagtta

SEQ ID NO: 1848 - DNA, 30 bp, synthetic construct
  misc_feature 1..30: note = Synthetic
  source 1..30: mol_type = other DNA
ttctctgcttgatcaagttataaaatcaca

SEQ ID NO: 1849 - DNA, 25 bp, synthetic construct
  misc_feature 1..25: note = Synthetic
  source 1..25: mol_type = other DNA
ttctctgcttgatcaagttataaaa

SEQ ID NO: 1850 - DNA, 20 bp, synthetic construct
  misc_feature 1..20: note = Synthetic
  source 1..20: mol_type = other DNA
tctctgcttgatcaagttat

SEQ ID NO: 1851 - DNA, 30 bp, synthetic construct
  misc_feature 1..30: note = Synthetic
  source 1..30: mol_type = other DNA
tctctgcttgatcaagttataaaatcacag

SEQ ID NO: 1852 - DNA, 25 bp, synthetic construct
  misc_feature 1..25: note = Synthetic
  source 1..25: mol_type = other DNA
tctctgcttgatcaagttataaaat

SEQ ID NO: 1853 - DNA, 30 bp, synthetic construct
  misc_feature 1..30: note = Synthetic
  source 1..30: mol_type = other DNA
ctctgcttgatcaagttataaaatcacaga

SEQ ID NO: 1854 - DNA, 30 bp, synthetic construct
  misc_feature 1..30: note = Synthetic
  source 1..30: mol_type = other DNA
tctgcttgatcaagttataaaatcacagag

SEQ ID NO: 1855 - DNA, 30 bp, synthetic construct
  misc_feature 1..30: note = Synthetic
  source 1..30: mol_type = other DNA
ctgcttgatcaagttataaaatcacagagg

SEQ ID NO: 1856 - DNA, 30 bp, synthetic construct
  misc_feature 1..30: note = Synthetic
  source 1..30: mol_type = other DNA
tgcttgatcaagttataaaatcacagaggg

SEQ ID NO: 1857 - DNA, 30 bp, synthetic construct
  misc_feature 1..30: note = Synthetic
  source 1..30: mol_type = other DNA
gcttgatcaagttataaaatcacagagggt

SEQ ID NO: 1858 - DNA, 30 bp, synthetic construct
  misc_feature 1..30: note = Synthetic
  source 1..30: mol_type = other DNA
cttgatcaagttataaaatcacagagggtg

SEQ ID NO: 1859 - DNA, 25 bp, synthetic construct
  misc_feature 1..25: note = Synthetic
  source 1..25: mol_type = other DNA
cttgatcaagttataaaatcacaga

SEQ ID NO: 1860 - DNA, 30 bp, synthetic construct
  misc_feature 1..30: note = Synthetic
  source 1..30: mol_type = other DNA
ttgatcaagttataaaatcacagagggtga

SEQ ID NO: 1861 - DNA, 25 bp, synthetic construct
  misc_feature 1..25: note = Synthetic
  source 1..25: mol_type = other DNA
ttgatcaagttataaaatcacagag

SEQ ID NO: 1862 - DNA, 30 bp, synthetic construct
  misc_feature 1..30: note = Synthetic
  source 1..30: mol_type = other DNA
tgatcaagttataaaatcacagagggtgat

SEQ ID NO: 1863 - DNA, 25 bp, synthetic construct
  misc_feature 1..25: note = Synthetic
  source 1..25: mol_type = other DNA
tgatcaagttataaaatcacagagg

SEQ ID NO: 1864 - DNA, 30 bp, synthetic construct
  misc_feature 1..30: note = Synthetic
  source 1..30: mol_type = other DNA
gatcaagttataaaatcacagagggtgatg

SEQ ID NO: 1865 - DNA, 25 bp, synthetic construct
  misc_feature 1..25: note = Synthetic
  source 1..25: mol_type = other DNA
gatcaagttataaaatcacagaggg

SEQ ID NO: 1866 - DNA, 30 bp, synthetic construct
  misc_feature 1..30: note = Synthetic
  source 1..30: mol_type = other DNA
atcaagttataaaatcacagagggtgatgg

SEQ ID NO: 1867 - DNA, 23 bp, synthetic construct
  misc_feature 1..23: note = Synthetic
  source 1..23: mol_type = other DNA
atcaagttataaaatcacagagg

SEQ ID NO: 1868 - DNA, 26 bp, synthetic construct
  misc_feature 1..26: note = Synthetic
  source 1..26: mol_type = other DNA
atcaagttataaaatcacagagggtg

SEQ ID NO: 1869 - DNA, 25 bp, synthetic construct
  misc_feature 1..25: note = Synthetic
  source 1..25: mol_type = other DNA
atcaagttataaaatcacagagggt

SEQ ID NO: 1870 - DNA, 20 bp, synthetic construct
  misc_feature 1..20: note = Synthetic
  source 1..20: mol_type = other DNA
tcaagttataaaatcacaga

SEQ ID NO: 1871 - DNA, 30 bp, synthetic construct
  misc_feature 1..30: note = Synthetic
  source 1..30: mol_type = other DNA
tcaagttataaaatcacagagggtgatggt

SEQ ID NO: 1872 - DNA, 21 bp, synthetic construct
  misc_feature 1..21: note = Synthetic
  source 1..21: mol_type = other DNA
tcaagttataaaatcacagag

SEQ ID NO: 1873 - DNA, 25 bp, synthetic construct
  misc_feature 1..25: note = Synthetic
  source 1..25: mol_type = other DNA
tcaagttataaaatcacagagggtg

SEQ ID NO: 1874 - DNA, 20 bp, synthetic construct
  misc_feature 1..20: note = Synthetic
  source 1..20: mol_type = other DNA
caagttataaaatcacagag

SEQ ID NO: 1875 - DNA, 30 bp, synthetic construct
  misc_feature 1..30: note = Synthetic
  source 1..30: mol_type = other DNA
caagttataaaatcacagagggtgatggtg

SEQ ID NO: 1876 - DNA, 21 bp, synthetic construct
  misc_feature 1..21: note = Synthetic
  source 1..21: mol_type = other DNA
caagttataaaatcacagagg

SEQ ID NO: 1877 - DNA, 25 bp, synthetic construct
  misc_feature 1..25: note = Synthetic
  source 1..25: mol_type = other DNA
caagttataaaatcacagagggtga

SEQ ID NO: 1878 - DNA, 20 bp, synthetic construct
  misc_feature 1..20: note = Synthetic
  source 1..20: mol_type = other DNA
aagttataaaatcacagagg

SEQ ID NO: 1879 - DNA, 30 bp, synthetic construct
  misc_feature 1..30: note = Synthetic
  source 1..30: mol_type = other DNA
aagttataaaatcacagagggtgatggtgg

SEQ ID NO: 1880 - DNA, 23 bp, synthetic construct
  misc_feature 1..23: note = Synthetic
  source 1..23: mol_type = other DNA
aagttataaaatcacagagggtg

SEQ ID NO: 1881 - DNA, 25 bp, synthetic construct
  misc_feature 1..25: note = Synthetic
  source 1..25: mol_type = other DNA
aagttataaaatcacagagggtgat

SEQ ID NO: 1882 - DNA, 20 bp, synthetic construct
  misc_feature 1..20: note = Synthetic
  source 1..20: mol_type = other DNA
agttataaaatcacagaggg

SEQ ID NO: 1883 - DNA, 30 bp, synthetic construct
  misc_feature 1..30: note = Synthetic
  source 1..30: mol_type = other DNA
agttataaaatcacagagggtgatggtggg

SEQ ID NO: 1884 - DNA, 25 bp, synthetic construct
  misc_feature 1..25: note = Synthetic
  source 1..25: mol_type = other DNA
agttataaaatcacagagggtgatg

SEQ ID NO: 1885 - DNA, 20 bp, synthetic construct
  misc_feature 1..20: note = Synthetic
  source 1..20: mol_type = other DNA
gttataaaatcacagagggt

SEQ ID NO: 1886 - DNA, 30 bp, synthetic construct
  misc_feature 1..30: note = Synthetic
  source 1..30: mol_type = other DNA
gttataaaatcacagagggtgatggtgggt

SEQ ID NO: 1887 - DNA, 25 bp, synthetic construct
  misc_feature 1..25: note = Synthetic
  source 1..25: mol_type = other DNA
gttataaaatcacagagggtgatgg

SEQ ID NO: 1888 - DNA, 20 bp, synthetic construct
  misc_feature 1..20: note = Synthetic
  source 1..20: mol_type = other DNA
ttataaaatcacagagggtg

SEQ ID NO: 1889 - DNA, 30 bp, synthetic construct
  misc_feature 1..30: note = Synthetic
  source 1..30: mol_type = other DNA
ttataaaatcacagagggtgatggtgggtg

SEQ ID NO: 1890 - DNA, 25 bp, synthetic construct
  misc_feature 1..25: note = Synthetic
  source 1..25: mol_type = other DNA
ttataaaatcacagagggtgatggt

SEQ ID NO: 1891 - DNA, 20 bp, synthetic construct
  misc_feature 1..20: note = Synthetic
  source 1..20: mol_type = other DNA
tataaaatcacagagggtga

SEQ ID NO: 1892 - DNA, 30 bp, synthetic construct
  misc_feature 1..30: note = Synthetic
  source 1..30: mol_type = other DNA
tataaaatcacagagggtgatggtgggtga

SEQ ID NO: 1893 - DNA, 25 bp, synthetic construct
  misc_feature 1..25: note = Synthetic
  source 1..25: mol_type = other DNA
tataaaatcacagagggtgatggtg

SEQ ID NO: 1894 - DNA, 20 bp, synthetic construct
  misc_feature 1..20: note = Synthetic
  source 1..20: mol_type = other DNA
ataaaatcacagagggtgat

SEQ ID NO: 1895 - DNA, 30 bp, synthetic construct
  misc_feature 1..30: note = Synthetic
  source 1..30: mol_type = other DNA
ataaaatcacagagggtgatggtgggtgac

SEQ ID NO: 1896 - DNA, 40 bp, synthetic construct
  misc_feature 1..40: note = Synthetic
  source 1..40: mol_type = other DNA
ataaaatcacagagggtgatggtgggtgaccttgaggata

SEQ ID NO: 1897 - DNA, 19 bp, synthetic construct
  misc_feature 1..19: note = Synthetic
  source 1..19: mol_type = other DNA
ataaaatcacagagggtga

SEQ ID NO: 1898 - DNA, 25 bp, synthetic construct
  misc_feature 1..25: note = Synthetic
  source 1..25: mol_type = other DNA
ataaaatcacagagggtgatggtgg

SEQ ID NO: 1899 - DNA, 20 bp, synthetic construct
  misc_feature 1..20: note = Synthetic
  source 1..20: mol_type = other DNA
taaaatcacagagggtgatg

SEQ ID NO: 1900 - DNA, 30 bp, synthetic construct
  misc_feature 1..30: note = Synthetic
  source 1..30: mol_type = other DNA
taaaatcacagagggtgatggtgggtgacc

SEQ ID NO: 1901 - DNA, 25 bp, synthetic construct
  misc_feature 1..25: note = Synthetic
  source 1..25: mol_type = other DNA
taaaatcacagagggtgatggtggg

SEQ ID NO: 1902 - DNA, 20 bp, synthetic construct
  misc_feature 1..20: note = Synthetic
  source 1..20: mol_type = other DNA
aaaatcacagagggtgatgg

SEQ ID NO: 1903 - DNA, 30 bp, synthetic construct
  misc_feature 1..30: note = Synthetic
  source 1..30: mol_type = other DNA
aaaatcacagagggtgatggtgggtgacct

SEQ ID NO: 1904 - DNA, 25 bp, synthetic construct
  misc_feature 1..25: note = Synthetic
  source 1..25: mol_type = other DNA
aaaatcacagagggtgatggtgggt

SEQ ID NO: 1905 - DNA, 20 bp, synthetic construct
  misc_feature 1..20: note = Synthetic
  source 1..20: mol_type = other DNA
aaatcacagagggtgatggt

SEQ ID NO: 1906 - DNA, 30 bp, synthetic construct
  misc_feature 1..30: note = Synthetic
  source 1..30: mol_type = other DNA
aaatcacagagggtgatggtgggtgacctt

SEQ ID NO: 1907 - DNA, 21 bp, synthetic construct
  misc_feature 1..21: note = Synthetic
  source 1..21: mol_type = other DNA
aaatcacagagggtgatggtg

SEQ ID NO: 1908 - DNA, 25 bp, synthetic construct
  misc_feature 1..25: note = Synthetic
  source 1..25: mol_type = other DNA
aaatcacagagggtgatggtgggtg

SEQ ID NO: 1909 - DNA, 20 bp, synthetic construct
  misc_feature 1..20: note = Synthetic
  source 1..20: mol_type = other DNA
aatcacagagggtgatggtg

SEQ ID NO: 1910 - DNA, 30 bp, synthetic construct
  misc_feature 1..30: note = Synthetic
  source 1..30: mol_type = other DNA
aatcacagagggtgatggtgggtgaccttg

SEQ ID NO: 1911 - DNA, 25 bp, synthetic construct
  misc_feature 1..25: note = Synthetic
  source 1..25: mol_type = other DNA
aatcacagagggtgatggtgggtga

SEQ ID NO: 1912 - DNA, 20 bp, synthetic construct
  misc_feature 1..20: note = Synthetic
  source 1..20: mol_type = other DNA
atcacagagggtgatggtgg

SEQ ID NO: 1913 - DNA, 30 bp, synthetic construct
  misc_feature 1..30: note = Synthetic
  source 1..30: mol_type = other DNA
atcacagagggtgatggtgggtgaccttga

SEQ ID NO: 1914 - DNA, 25 bp, synthetic construct
  misc_feature 1..25: note = Synthetic
  source 1..25: mol_type = other DNA
atcacagagggtgatggtgggtgac

SEQ ID NO: 1915 - DNA, 20 bp, synthetic construct
  misc_feature 1..20: note = Synthetic
  source 1..20: mol_type = other DNA
tcacagagggtgatggtggg

SEQ ID NO: 1916 - DNA, 30 bp, synthetic construct
  misc_feature 1..30: note = Synthetic
  source 1..30: mol_type = other DNA
tcacagagggtgatggtgggtgaccttgag

SEQ ID NO: 1917 - DNA, 25 bp, synthetic construct
  misc_feature 1..25: note = Synthetic
  source 1..25: mol_type = other DNA
tcacagagggtgatggtgggtgacc

SEQ ID NO: 1918 - DNA, 20 bp, synthetic construct
  misc_feature 1..20: note = Synthetic
  source 1..20: mol_type = other DNA
cacagagggtgatggtgggt

SEQ ID NO: 1919 - DNA, 30 bp, synthetic construct
  misc_feature 1..30: note = Synthetic
  source 1..30: mol_type = other DNA
cacagagggtgatggtgggtgaccttgagg

SEQ ID NO: 1920 - DNA, 21 bp, synthetic construct
  misc_feature 1..21: note = Synthetic
  source 1..21: mol_type = other DNA
cacagagggtgatggtgggtg

SEQ ID NO: 1921 - DNA, 25 bp, synthetic construct
  misc_feature 1..25: note = Synthetic
  source 1..25: mol_type = other DNA
cacagagggtgatggtgggtgacct

SEQ ID NO: 1922 - DNA, 20 bp, synthetic construct
  misc_feature 1..20: note = Synthetic
  source 1..20: mol_type = other DNA
acagagggtgatggtgggtg

SEQ ID NO: 1923 - DNA, 30 bp, synthetic construct
  misc_feature 1..30: note = Synthetic
  source 1..30: mol_type = other DNA
acagagggtgatggtgggtgaccttgagga

SEQ ID NO: 1924 - DNA, 25 bp, synthetic construct
  misc_feature 1..25: note = Synthetic
  source 1..25: mol_type = other DNA
acagagggtgatggtgggtgacctt

SEQ ID NO: 1925 - DNA, 33 bp, synthetic construct
  misc_feature 1..33: note = Synthetic
  source 1..33: mol_type = other DNA
acagagggtgatggtgggtgaccttgaggatat

SEQ ID NO: 1926 - DNA, 26 bp, synthetic construct
  misc_feature 1..26: note = Synthetic
  source 1..26: mol_type = other DNA
acagagggtgatggtgggtgaccttg

SEQ ID NO: 1927 - DNA, 20 bp, synthetic construct
  misc_feature 1..20: note = Synthetic
  source 1..20: mol_type = other DNA
cagagggtgatggtgggtga

SEQ ID NO: 1928 - DNA, 30 bp, synthetic construct
  misc_feature 1..30: note = Synthetic
  source 1..30: mol_type = other DNA
cagagggtgatggtgggtgaccttgaggat

SEQ ID NO: 1929 - DNA, 25 bp, synthetic construct
  misc_feature 1..25: note = Synthetic
  source 1..25: mol_type = other DNA
cagagggtgatggtgggtgaccttg

SEQ ID NO: 1930 - DNA, 30 bp, synthetic construct
  misc_feature 1..30: note = Synthetic
  source 1..30: mol_type = other DNA
agagggtgatggtgggtgaccttgaggata

SEQ ID NO: 1931 - DNA, 30 bp, synthetic construct
  misc_feature 1..30: note = Synthetic
  source 1..30: mol_type = other DNA
gagggtgatggtgggtgaccttgaggatat

SEQ ID NO: 1932 - DNA, 30 bp, synthetic construct
  misc_feature 1..30: note = Synthetic
  source 1..30: mol_type = other DNA
agggtgatggtgggtgaccttgaggatatc

SEQ ID NO: 1933 - DNA, 25 bp, synthetic construct
  misc_feature 1..25: note = Synthetic
  source 1..25: mol_type = other DNA
agggtgatggtgggtgaccttgagg

SEQ ID NO: 1934 - DNA, 30 bp, synthetic construct
  misc_feature 1..30: note = Synthetic
  source 1..30: mol_type = other DNA
gggtgatggtgggtgaccttgaggatatca

SEQ ID NO: 1935 - DNA, 25 bp, synthetic construct
  misc_feature 1..25: note = Synthetic
  source 1..25: mol_type = other DNA
gggtgatggtgggtgaccttgagga

SEQ ID NO: 1936 - DNA, 30 bp, synthetic construct
  misc_feature 1..30: note = Synthetic
  source 1..30: mol_type = other DNA
ggtgatggtgggtgaccttgaggatatcaa

SEQ ID NO: 1937 - DNA, 25 bp, synthetic construct
  misc_feature 1..25: note = Synthetic
  source 1..25: mol_type = other DNA
ggtgatggtgggtgaccttgaggat

SEQ ID NO: 1938 - DNA, 30 bp, synthetic construct
  misc_feature 1..30: note = Synthetic
  source 1..30: mol_type = other DNA
gtgatggtgggtgaccttgaggatatcaac

SEQ ID NO: 1939 - DNA, 25 bp, synthetic construct
  misc_feature 1..25: note = Synthetic
  source 1..25: mol_type = other DNA
gtgatggtgggtgaccttgaggata

SEQ ID NO: 1940 - DNA, 30 bp, synthetic construct
  misc_feature 1..30: note = Synthetic
  source 1..30: mol_type = other DNA
tgatggtgggtgaccttgaggatatcaacg

SEQ ID NO: 1941 - DNA, 25 bp, synthetic construct
  misc_feature 1..25: note = Synthetic
  source 1..25: mol_type = other DNA
tgatggtgggtgaccttgaggatat

SEQ ID NO: 1942 - DNA, 20 bp, synthetic construct
  misc_feature 1..20: note = Synthetic
  source 1..20: mol_type = other DNA
gatggtgggtgaccttgagg

SEQ ID NO: 1943 - DNA, 30 bp, synthetic construct
  misc_feature 1..30: note = Synthetic
  source 1..30: mol_type = other DNA
gatggtgggtgaccttgaggatatcaacga

SEQ ID NO: 1944 - DNA, 25 bp, synthetic construct
  misc_feature 1..25: note = Synthetic
  source 1..25: mol_type = other DNA
gatggtgggtgaccttgaggatatc

SEQ ID NO: 1945 - DNA, 20 bp, synthetic construct
  misc_feature 1..20: note = Synthetic
  source 1..20: mol_type = other DNA
atggtgggtgaccttgagga

SEQ ID NO: 1946 - DNA, 30 bp, synthetic construct
  misc_feature 1..30: note = Synthetic
  source 1..30: mol_type = other DNA
atggtgggtgaccttgaggatatcaacgag

SEQ ID NO: 1947 - DNA, 25 bp, synthetic construct
  misc_feature 1..25: note = Synthetic
  source 1..25: mol_type = other DNA
atggtgggtgaccttgaggatatca

SEQ ID NO: 1948 - DNA, 20 bp, synthetic construct
  misc_feature 1..20: note = Synthetic
  source 1..20: mol_type = other DNA
tggtgggtgaccttgaggat

SEQ ID NO: 1949 - DNA, 30 bp, synthetic construct
  misc_feature 1..30: note = Synthetic
  source 1..30: mol_type = other DNA
tggtgggtgaccttgaggatatcaacgaga

SEQ ID NO: 1950 - DNA, 25 bp, synthetic construct
  misc_feature 1..25: note = Synthetic
  source 1..25: mol_type = other DNA
tggtgggtgaccttgaggatatcaa

SEQ ID NO: 1951 - DNA, 20 bp, synthetic construct
  misc_feature 1..20: note = Synthetic
  source 1..20: mol_type = other DNA
ggtgggtgaccttgaggata

SEQ ID NO: 1952 - DNA, 30 bp, synthetic construct
  misc_feature 1..30: note = Synthetic
  source 1..30: mol_type = other DNA
ggtgggtgaccttgaggatatcaacgagat

SEQ ID NO: 1953 - DNA, 19 bp, synthetic construct
  misc_feature 1..19: note = Synthetic
  source 1..19: mol_type = other DNA
ggtgggtgaccttgaggat

SEQ ID NO: 1954 - DNA, 23 bp, synthetic construct
  misc_feature 1..23: note = Synthetic
  source 1..23: mol_type = other DNA
ggtgggtgaccttgaggatatca

SEQ ID NO: 1955 - DNA, 25 bp, synthetic construct
  misc_feature 1..25: note = Synthetic
  source 1..25: mol_type = other DNA
ggtgggtgaccttgaggatatcaac

SEQ ID NO: 1956 - DNA, 20 bp, synthetic construct
  misc_feature 1..20: note = Synthetic
  source 1..20: mol_type = other DNA
gtgggtgaccttgaggatat

SEQ ID NO: 1957 - DNA, 30 bp, synthetic construct
  misc_feature 1..30: note = Synthetic
  source 1..30: mol_type = other DNA
gtgggtgaccttgaggatatcaacgagatg

SEQ ID NO: 1958 - DNA, 25 bp, synthetic construct
  misc_feature 1..25: note = Synthetic
  source 1..25: mol_type = other DNA
gtgggtgaccttgaggatatcaacg

SEQ ID NO: 1959 - DNA, 20 bp, synthetic construct
  misc_feature 1..20: note = Synthetic
  source 1..20: mol_type = other DNA
tgggtgaccttgaggatatc

SEQ ID NO: 1960 - DNA, 30 bp, synthetic construct
  misc_feature 1..30: note = Synthetic
  source 1..30: mol_type = other DNA
tgggtgaccttgaggatatcaacgagatga

SEQ ID NO: 1961 - DNA, 25 bp, synthetic construct
  misc_feature 1..25: note = Synthetic
  source 1..25: mol_type = other DNA
tgggtgaccttgaggatatcaacga

SEQ ID NO: 1962 - DNA, 20 bp, synthetic construct
  misc_feature 1..20: note = Synthetic
  source 1..20: mol_type = other DNA
gggtgaccttgaggatatca

SEQ ID NO: 1963 - DNA, 30 bp, synthetic construct
  misc_feature 1..30: note = Synthetic
  source 1..30: mol_type = other DNA
gggtgaccttgaggatatcaacgagatgat

SEQ ID NO: 1964 - DNA, 21 bp, synthetic construct
  misc_feature 1..21: note = Synthetic
  source 1..21: mol_type = other DNA
gggtgaccttgaggatatcaa

SEQ ID NO: 1965 - DNA, 25 bp, synthetic construct
  misc_feature 1..25: note = Synthetic
  source 1..25: mol_type = other DNA
gggtgaccttgaggatatcaacgag

SEQ ID NO: 1966 - DNA, 20 bp, synthetic construct
  misc_feature 1..20: note = Synthetic
  source 1..20: mol_type = other DNA
ggtgaccttgaggatatcaa

SEQ ID NO: 1967 - DNA, 30 bp, synthetic construct
  misc_feature 1..30: note = Synthetic
  source 1..30: mol_type = other DNA
ggtgaccttgaggatatcaacgagatgatc

SEQ ID NO: 1968 - DNA, 19 bp, synthetic construct
  misc_feature 1..19: note = Synthetic
  source 1..19: mol_type = other DNA
ggtgaccttgaggatatca

SEQ ID NO: 1969 - DNA, 26 bp, synthetic construct
  misc_feature 1..26: note = Synthetic
  source 1..26: mol_type = other DNA
ggtgaccttgaggatatcaacgagat

SEQ ID NO: 1970 - DNA, 25 bp, synthetic construct
  misc_feature 1..25: note = Synthetic
  source 1..25: mol_type = other DNA
ggtgaccttgaggatatcaacgaga

SEQ ID NO: 1971 - DNA, 20 bp, synthetic construct
  misc_feature 1..20: note = Synthetic
  source 1..20: mol_type = other DNA
gtgaccttgaggatatcaac

SEQ ID NO: 1972 - DNA, 30 bp, synthetic construct
  misc_feature 1..30: note = Synthetic
  source 1..30: mol_type = other DNA
gtgaccttgaggatatcaacgagatgatca

SEQ ID NO: 1973 - DNA, 25 bp, synthetic construct
  misc_feature 1..25: note = Synthetic
  source 1..25: mol_type = other DNA
gtgaccttgaggatatcaacgagat

SEQ ID NO: 1974 - DNA, 20 bp, synthetic construct
  misc_feature 1..20: note = Synthetic
  source 1..20: mol_type = other DNA
tgaccttgaggatatcaacg

SEQ ID NO: 1975 - DNA, 30 bp, synthetic construct
  misc_feature 1..30: note = Synthetic
  source 1..30: mol_type = other DNA
tgaccttgaggatatcaacgagatgatcat

SEQ ID NO: 1976 - DNA, 34 bp, synthetic construct
  misc_feature 1..34: note = Synthetic
  source 1..34: mol_type = other DNA
tgaccttgaggatatcaacgagatgatcatcaag

SEQ ID NO: 1977 - DNA, 37 bp, synthetic construct
  misc_feature 1..37: note = Synthetic
  source 1..37: mol_type = other DNA
tgaccttgaggatatcaacgagatgatcatcaagcag

SEQ ID NO: 1978 - DNA, 25 bp, synthetic construct
  misc_feature 1..25: note = Synthetic
  source 1..25: mol_type = other DNA
tgaccttgaggatatcaacgagatg

SEQ ID NO: 1979 - DNA, 20 bp, synthetic construct
  misc_feature 1..20: note = Synthetic
  source 1..20: mol_type = other DNA
gaccttgaggatatcaacga

SEQ ID NO: 1980 - DNA, 30 bp, synthetic construct
  misc_feature 1..30: note = Synthetic
  source 1..30: mol_type = other DNA
gaccttgaggatatcaacgagatgatcatc

SEQ ID NO: 1981 - DNA, 25 bp, synthetic construct
  misc_feature 1..25: note = Synthetic
  source 1..25: mol_type = other DNA
gaccttgaggatatcaacgagatga

SEQ ID NO: 1982 - DNA, 20 bp, synthetic construct
  misc_feature 1..20: note = Synthetic
  source 1..20: mol_type = other DNA
accttgaggatatcaacgag

SEQ ID NO: 1983 - DNA, 30 bp, synthetic construct
  misc_feature 1..30: note = Synthetic
  source 1..30: mol_type = other DNA
accttgaggatatcaacgagatgatcatca

SEQ ID NO: 1984 - DNA, 25 bp, synthetic construct
  misc_feature 1..25: note = Synthetic
  source 1..25: mol_type = other DNA
accttgaggatatcaacgagatgat

SEQ ID NO: 1985 - DNA, 20 bp, synthetic construct
  misc_feature 1..20: note = Synthetic
  source 1..20: mol_type = other DNA
ccttgaggatatcaacgaga

SEQ ID NO: 1986 - DNA, 30 bp, synthetic construct
  misc_feature 1..30: note = Synthetic
  source 1..30: mol_type = other DNA
ccttgaggatatcaacgagatgatcatcaa

SEQ ID NO: 1987 - DNA, 25 bp, synthetic construct
  misc_feature 1..25: note = Synthetic
  source 1..25: mol_type = other DNA
ccttgaggatatcaacgagatgatc

SEQ ID NO: 1988 - DNA, 20 bp, synthetic construct
  misc_feature 1..20: note = Synthetic
  source 1..20: mol_type = other DNA
cttgaggatatcaacgagat

SEQ ID NO: 1989 - DNA, 30 bp, synthetic construct
  misc_feature 1..30: note = Synthetic
  source 1..30: mol_type = other DNA
cttgaggatatcaacgagatgatcatcaag

SEQ ID NO: 1990 - DNA, 25 bp, synthetic construct
  misc_feature 1..25: note = Synthetic
  source 1..25: mol_type = other DNA
cttgaggatatcaacgagatgatca

SEQ ID NO: 1991 - DNA, 20 bp, synthetic construct
  misc_feature 1..20: note = Synthetic
  source 1..20: mol_type = other DNA
ttgaggatatcaacgagatg

SEQ ID NO: 1992 - DNA, 30 bp, synthetic construct
  misc_feature 1..30: note = Synthetic
  source 1..30: mol_type = other DNA
ttgaggatatcaacgagatgatcatcaagc

SEQ ID NO: 1993 - DNA, 33 bp, synthetic construct
  misc_feature 1..33: note = Synthetic
  source 1..33: mol_type = other DNA
ttgaggatatcaacgagatgatcatcaagcaga

SEQ ID NO: 1994 - DNA, 22 bp, synthetic construct
  misc_feature 1..22: note = Synthetic
  source 1..22: mol_type = other DNA
ttgaggatatcaacgagatgat

SEQ ID NO: 1995 - DNA, 25 bp, synthetic construct
  misc_feature 1..25: note = Synthetic
  source 1..25: mol_type = other DNA
ttgaggatatcaacgagatgatcat

SEQ ID NO: 1996 - DNA, 20 bp, synthetic construct
  misc_feature 1..20: note = Synthetic
  source 1..20: mol_type = other DNA
tgaggatatcaacgagatga

SEQ ID NO: 1997 - DNA, 30 bp, synthetic construct
  misc_feature 1..30: note = Synthetic
  source 1..30: mol_type = other DNA
tgaggatatcaacgagatgatcatcaagca

SEQ ID NO: 1998 - DNA, 25 bp, synthetic construct
  misc_feature 1..25: note = Synthetic
  source 1..25: mol_type = other DNA
tgaggatatcaacgagatgatcatc

SEQ ID NO: 1999 - DNA, 20 bp, synthetic construct
  misc_feature 1..20: note = Synthetic
  source 1..20: mol_type = other DNA
gaggatatcaacgagatgat

SEQ ID NO: 2000 - DNA, 30 bp, synthetic construct
  misc_feature 1..30: note = Synthetic
  source 1..30: mol_type = other DNA
gaggatatcaacgagatgatcatcaagcag

SEQ ID NO: 2001 - DNA, 21 bp, synthetic construct
  misc_feature 1..21: note = Synthetic
  source 1..21: mol_type = other DNA
gaggatatcaacgagatgatc

SEQ ID NO: 2002 - DNA, 25 bp, synthetic construct
  misc_feature 1..25: note = Synthetic
  source 1..25: mol_type = other DNA
gaggatatcaacgagatgatcatca

SEQ ID NO: 2003 - DNA, 20 bp, synthetic construct
  misc_feature 1..20: note = Synthetic
  source 1..20: mol_type = other DNA
aggatatcaacgagatgatc

SEQ ID NO: 2004 - DNA, 30 bp, synthetic construct
  misc_feature 1..30: note = Synthetic
  source 1..30: mol_type = other DNA
aggatatcaacgagatgatcatcaagcaga

SEQ ID NO: 2005 - DNA, 25 bp, synthetic construct
  misc_feature 1..25: note = Synthetic
  source 1..25: mol_type = other DNA
aggatatcaacgagatgatcatcaa

SEQ ID NO: 2006 - DNA, 20 bp, synthetic construct
  misc_feature 1..20: note = Synthetic
  source 1..20: mol_type = other DNA
ggatatcaacgagatgatca

SEQ ID NO: 2007 - DNA, 30 bp, synthetic construct
  misc_feature 1..30: note = Synthetic
  source 1..30: mol_type = other DNA
ggatatcaacgagatgatcatcaagcagaa

SEQ ID NO: 2008 - DNA, 25 bp, synthetic construct
  misc_feature 1..25: note = Synthetic
  source 1..25: mol_type = other DNA
ggatatcaacgagatgatcatcaag

SEQ ID NO: 2009 - DNA, 20 bp, synthetic construct
  misc_feature 1..20: note = Synthetic
  source 1..20: mol_type = other DNA
gatatcaacgagatgatcat

SEQ ID NO: 2010 - DNA, 30 bp, synthetic construct
  misc_feature 1..30: note = Synthetic
  source 1..30: mol_type = other DNA
gatatcaacgagatgatcatcaagcagaag

SEQ ID NO: 2011 - DNA, 25 bp, synthetic construct
  misc_feature 1..25: note = Synthetic
  source 1..25: mol_type = other DNA
gatatcaacgagatgatcatcaagc

SEQ ID NO: 2012 - DNA, 20 bp, synthetic construct
  misc_feature 1..20: note = Synthetic
  source 1..20: mol_type = other DNA
atatcaacgagatgatcatc

SEQ ID NO: 2013 - DNA, 30 bp, synthetic construct
  misc_feature 1..30: note = Synthetic
  source 1..30: mol_type = other DNA
atatcaacgagatgatcatcaagcagaagg

SEQ ID NO: 2014 - DNA, 27 bp, synthetic construct
  misc_feature 1..27: note = Synthetic
  source 1..27: mol_type = other DNA
atatcaacgagatgatcatcaagcaga

SEQ ID NO: 2015 - DNA, 29 bp, synthetic construct
  misc_feature 1..29: note = Synthetic
  source 1..29: mol_type = other DNA
atatcaacgagatgatcatcaagcagaag

SEQ ID NO: 2016 - DNA, 25 bp, synthetic construct
  misc_feature 1..25: note = Synthetic
  source 1..25: mol_type = other DNA
atatcaacgagatgatcatcaagca

SEQ ID NO: 2017 - DNA, 20 bp, synthetic construct
  misc_feature 1..20: note = Synthetic
  source 1..20: mol_type = other DNA
tatcaacgagatgatcatca

SEQ ID NO: 2018 - DNA, 30 bp, synthetic construct
  misc_feature 1..30: note = Synthetic
  source 1..30: mol_type = other DNA
tatcaacgagatgatcatcaagcagaaggt

SEQ ID NO: 2019 - DNA, 25 bp, synthetic construct
  misc_feature 1..25: note = Synthetic
  source 1..25: mol_type = other DNA
tatcaacgagatgatcatcaagcag

SEQ ID NO: 2020 - DNA, 20 bp, synthetic construct
  misc_feature 1..20: note = Synthetic
  source 1..20: mol_type = other DNA
atcaacgagatgatcatcaa

SEQ ID NO: 2021 - DNA, 30 bp, synthetic construct
  misc_feature 1..30: note = Synthetic
  source 1..30: mol_type = other DNA
atcaacgagatgatcatcaagcagaaggta

SEQ ID NO: 2022 - DNA, 25 bp, synthetic construct
  misc_feature 1..25: note = Synthetic
  source 1..25: mol_type = other DNA
atcaacgagatgatcatcaagcaga

SEQ ID NO: 2023 - DNA, 20 bp, synthetic construct
  misc_feature 1..20: note = Synthetic
  source 1..20: mol_type = other DNA
tcaacgagatgatcatcaag

SEQ ID NO: 2024 - DNA, 30 bp, synthetic construct
  misc_feature 1..30: note = Synthetic
  source 1..30: mol_type = other DNA
tcaacgagatgatcatcaagcagaaggtat

SEQ ID NO: 2025 - DNA, 26 bp, synthetic construct
  misc_feature 1..26: note = Synthetic
  source 1..26: mol_type = other DNA
tcaacgagatgatcatcaagcagaag

SEQ ID NO: 2026 - DNA, 25 bp, synthetic construct
  misc_feature 1..25: note = Synthetic
  source 1..25: mol_type = other DNA
tcaacgagatgatcatcaagcagaa

SEQ ID NO: 2027 - DNA, 20 bp, synthetic construct
  misc_feature 1..20: note = Synthetic
  source 1..20: mol_type = other DNA
caacgagatgatcatcaagc

SEQ ID NO: 2028 - DNA, 30 bp, synthetic construct
  misc_feature 1..30: note = Synthetic
  source 1..30: mol_type = other DNA
caacgagatgatcatcaagcagaaggtatg

SEQ ID NO: 2029 - DNA, 22 bp, synthetic construct
  misc_feature 1..22: note = Synthetic
  source 1..22: mol_type = other DNA
caacgagatgatcatcaagcag

SEQ ID NO: 2030 - DNA, 26 bp, synthetic construct
  misc_feature 1..26: note = Synthetic
  source 1..26: mol_type = other DNA
caacgagatgatcatcaagcagaagg

SEQ ID NO: 2031 - DNA, 25 bp, synthetic construct
  misc_feature 1..25: note = Synthetic
  source 1..25: mol_type = other DNA
caacgagatgatcatcaagcagaag

SEQ ID NO: 2032 - DNA, 20 bp, synthetic construct
  misc_feature 1..20: note = Synthetic
  source 1..20: mol_type = other DNA
aacgagatgatcatcaagca

SEQ ID NO: 2033 - DNA, 30 bp, synthetic construct
  misc_feature 1..30: note = Synthetic
  source 1..30: mol_type = other DNA
aacgagatgatcatcaagcagaaggtatga

SEQ ID NO: 2034 - DNA, 21 bp, synthetic construct
  misc_feature 1..21: note = Synthetic
  source 1..21: mol_type = other DNA
aacgagatgatcatcaagcag

SEQ ID NO: 2035 - DNA, 20 bp, synthetic construct
  misc_feature 1..20: note = Synthetic
  source 1..20: mol_type = other DNA
acgagatgatcatcaagcag

SEQ ID NO: 2036 - DNA, 30 bp, synthetic construct
  misc_feature 1..30: note = Synthetic
  source 1..30: mol_type = other DNA
acgagatgatcatcaagcagaaggtatgag

SEQ ID NO: 2037 - DNA, 21 bp, synthetic construct
  misc_feature 1..21: note = Synthetic
  source 1..21: mol_type = other DNA
acgagatgatcatcaagcaga

SEQ ID NO: 2038 - DNA, 25 bp, synthetic construct
  misc_feature 1..25: note = Synthetic
  source 1..25: mol_type = other DNA
acgagatgatcatcaagcagaaggt

SEQ ID NO: 2039 - DNA, 20 bp, synthetic construct
  misc_feature 1..20: note = Synthetic
  source 1..20: mol_type = other DNA
cgagatgatcatcaagcaga

SEQ ID NO: 2040 - DNA, 30 bp, synthetic construct
  misc_feature 1..30: note = Synthetic
  source 1..30: mol_type = other DNA
cgagatgatcatcaagcagaaggtatgaga

SEQ ID NO: 2041 - DNA, 20 bp, synthetic construct
  misc_feature 1..20: note = Synthetic
  source 1..20: mol_type = other DNA
gagatgatcatcaagcagaa

SEQ ID NO: 2042 - DNA, 30 bp, synthetic construct
  misc_feature 1..30: note = Synthetic
  source 1..30: mol_type = other DNA
gagatgatcatcaagcagaaggtatgagaa

SEQ ID NO: 2043 - DNA, 21 bp, synthetic construct
  misc_feature 1..21: note = Synthetic
  source 1..21: mol_type = other DNA
gagatgatcatcaagcagaag

SEQ ID NO: 2044 - DNA, 18 bp, synthetic construct
  misc_feature 1..18: note = Synthetic
  source 1..18: mol_type = other DNA
gagatgatcatcaagcag

SEQ ID NO: 2045 - DNA, 19 bp, synthetic construct
  misc_feature 1..19: note = Synthetic
  source 1..19: mol_type = other DNA
gagatgatcatcaagcaga

SEQ ID NO: 2046 - DNA, 29 bp, synthetic construct
  misc_feature 1..29: note = Synthetic
  source 1..29: mol_type = other DNA
gagatgatcatcaagcagaaggtatgaga

SEQ ID NO: 2047-2238 - skipped (192 entries)

SEQ ID NO: 2239 - DNA, 13993 bp, Homo sapiens
  source 1..13993: mol_type = genomic DNA
tcctggcatcagttactgtgttgactcactcagtgttgggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 2240 - DNA, 182 bp, Homo sapiens
  source 1..182: mol_type = genomic DNA
atgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacag

SEQ ID NO: 2241 - DNA, 213 bp, Homo sapiens
  source 1..213: mol_type = genomic DNA
gctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcag

SEQ ID NO: 2242 - DNA, 173 bp, Homo sapiens
  source 1..173: mol_type = genomic DNA
aatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagg

SEQ ID NO: 2243 - DNA, 148 bp, Homo sapiens
  source 1..148: mol_type = genomic DNA
gcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaag

SEQ ID NO: 2244 - DNA, 176 bp, Homo sapiens
  source 1..176: mol_type = genomic DNA
gaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagag

SEQ ID NO: 2245 - DNA, 148 bp, Homo sapiens
  source 1..148: mol_type = genomic DNA
gctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaag

SEQ ID NO: 2246 - DNA, 109 bp, Homo sapiens
  source 1..109: mol_type = genomic DNA
aggaagttagaagatctgagctctgagtggaaggcggtaaaccgtttacttcaagagctgagggcaaagcagcctgacctagctcctggactgaccactattggagcct

SEQ ID NO: 2247 - DNA, 233 bp, Homo sapiens
  source 1..233: mol_type = genomic DNA
ctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaag

SEQ ID NO: 2248 - DNA, 118 bp, Homo sapiens
  source 1..118: mol_type = genomic DNA
gcaacaatgcaggatttggaacagaggcgtccccagttggaagaactcattaccgctgcccaaaatttgaaaaacaagaccagcaatcaagaggctagaacaatcattacggatcgaa

SEQ ID NO: 2249 - DNA, 212 bp, Homo sapiens
  source 1..212: mol_type = genomic DNA
ttgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaag

SEQ ID NO: 2250 - DNA, 190 bp, Homo sapiens
  source 1..190: mol_type = genomic DNA
ggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaa

SEQ ID NO: 2251 - RNA, 21 nt, synthetic construct
  misc_feature 1..21: note = Synthetic
  source 1..21: mol_type = other RNA
cctccggttctgaaggtgttc

SEQ ID NO: 2252 - RNA, 18 nt, synthetic construct
  misc_feature 1..18: note = Synthetic
  source 1..18: mol_type = other RNA
cgctgcccaatgccatcc

SEQ ID NO: 2253 - DNA, 22 bp, synthetic construct
  misc_feature 1..22: note = Synthetic
  source 1..22: mol_type = other DNA
caacttcagccatccatttctg

SEQ ID NO: 2254 - DNA, 20 bp, synthetic construct
  misc_feature 1..20: note = Synthetic
  source 1..20: mol_type = other DNA
tcaaggaagatggcatttct

SEQ ID NO: 2255 - DNA, 22 bp, synthetic construct
  misc_feature 1..22: note = Synthetic
  source 1..22: mol_type = other DNA
caatgccatcctggagttcctg

SEQ ID NO: 2256 - DNA, 25 bp, synthetic construct
  misc_feature 1..25: note = Synthetic
  source 1..25: mol_type = other DNA
gttgcctccggttctgaaggtgttc

SEQ ID NO: 2257 - DNA, 21 bp, synthetic construct
  misc_feature 1..21: note = Synthetic
  source 1..21: mol_type = other DNA
cctccggttctgaaggtgttc

SEQ ID NO: 2258 - DNA, 18 bp, synthetic construct
  misc_feature 1..18: note = Synthetic
  source 1..18: mol_type = other DNA
cgctgcccaatgccatcc

SEQ ID NO: 2259 - DNA, 20 bp, synthetic construct
  misc_feature 1..20: note = Synthetic
  source 1..20: mol_type = other DNA
agaaatgccatcttccttga

SEQ ID NO: 2260 - DNA, 22 bp, synthetic construct
  misc_feature 1..22: note = Synthetic
  source 1..22: mol_type = other DNA
caggaactccaggatggcattg

SEQ ID NO: 2261 - DNA, 25 bp, synthetic construct
  misc_feature 1..25: note = Synthetic
  source 1..25: mol_type = other DNA
gaacaccttcagaaccggaggcaac

SEQ ID NO: 2262 - DNA, 21 bp, synthetic construct
  misc_feature 1..21: note = Synthetic
  source 1..21: mol_type = other DNA
gaacaccttcagaaccggagg

SEQ ID NO: 2263 - DNA, 18 bp, synthetic construct
  misc_feature 1..18: note = Synthetic
  source 1..18: mol_type = other DNA
ggatggcattgggcagcg

SEQ ID NO: 2264 - DNA, 21 bp, synthetic construct
  misc_feature 1..21: note = Synthetic
  source 1..21: mol_type = other DNA
cacatctttgatggtgtgagg

SEQ ID NO: 2265 - protein, 10 aa, synthetic construct
  REGION 1..10: note = Synthetic
GYTFTNYWMH

SEQ ID NO: 2266 - protein, 17 aa, synthetic construct
  REGION 1..17: note = Synthetic
EINPINGRSNYGERFKT

SEQ ID NO: 2267 - protein, 7 aa, synthetic construct
  REGION 1..7: note = Synthetic
GTRAMHY

SEQ ID NO: 2268 - protein, 11 aa, synthetic construct
  REGION 1..11: note = Synthetic
RTSENIYNNLA

SEQ ID NO: 2269 - protein, 7 aa, synthetic construct
  REGION 1..7: note = Synthetic
AATNLAD

SEQ ID NO: 2270 - protein, 10 aa, synthetic construct
  REGION 1..10: note = Synthetic
QHFWGTPLTF

SEQ ID NO: 2271 - protein, 116 aa, synthetic construct
  REGION 1..116: note = Synthetic
QVQLQQPGAELVKPGASVKLSCKASGYTFTNYWMHWVKQRPGQGLEWIGEINPINGRSNYGERFKTKATLTVDKSSSTAYMQLSSLTSEDSAVYYCARGTRAMHYWGQGTSVTVSS

SEQ ID NO: 2272 - protein, 107 aa, synthetic construct
  REGION 1..107: note = Synthetic
DIQMTQSPASLSVSVGETVTITCRTSENIYNNLAWYQQKQGKSPQLLVYAATNLADGVPSRFSGSGSGTQYSLKINSLQSEDFGNYYCQHFWGTPLTFGAGTKLELK

SEQ ID NO: 2273 - protein, 9 aa, synthetic construct
  REGION 1..9: note = Synthetic
YTFTNYWMH

SEQ ID NO: 2274 - protein, 17 aa, synthetic construct
  REGION 1..17: note = Synthetic
EINPINGRSNYAQKFQG

SEQ ID NO: 2275 - protein, 17 aa, synthetic construct
  REGION 1..17: note = Synthetic
EINPINGRSNYAEKFQG

SEQ ID NO: 2276 - protein, 17 aa, synthetic construct
  REGION 1..17: note = Synthetic
EINPIQGRSNYAEKFQG

SEQ ID NO: 2277 - protein, 7 aa, synthetic construct
  REGION 1..7: note = Synthetic
AATNLAE

SEQ ID NO: 2278 - protein, 11 aa, synthetic construct
  REGION 1..11: note = Synthetic
RTSENIYSNLA

SEQ ID NO: 2279 - protein, 7 aa, synthetic construct
  REGION 1..7: note = Synthetic
AGTNLAD

SEQ ID NO: 2280 - protein, 116 aa, synthetic construct
  REGION 1..116: note = Synthetic
QVQLVQSGAEVKKPGASVKVSCKASGYTFTNYWMHWVRQAPGQGLEWMGEINPINGRSNYAQKFQGRVTLTVDTSISTAYMELSRLRSDDTAVYYCARGTRAMHYWGQGTLVTVSS

SEQ ID NO: 2281 - protein, 116 aa, synthetic construct
  REGION 1..116: note = Synthetic
QVQLVQSGAEVKKPGASVKVSCKASGYTFTNYWMHWVRQAPGQGLEWIGEINPINGRSNYAEKFQGRVTLTVDTSSSTAYMELSRLRSDDTAVYYCARGTRAMHYWGQGTLVTVSS

SEQ ID NO: 2282 - protein, 116 aa, synthetic construct
  REGION 1..116: note = Synthetic
QVQLVQSGAEVKKPGASVKVSCKASGYTFTNYWMHWVRQAPGQGLEWMGEINPIQGRSNYAEKFQGRVTLTVDTSSSTAYMELSSLRSEDTATYYCARGTRAMHYWGQGTLVTVSS

SEQ ID NO: 2283 - protein, 116 aa, synthetic construct
  REGION 1..116: note = Synthetic
QVQLVQSGAEVKKPGASVKVSCKASGYTFTNYWMHWVRQAPGQGLEWMGEINPINGRSNYAEKFQGRVTLTVDTSSSTAYMELSSLRSEDTATYYCARGTRAMHYWGQGTLVTVSS

SEQ ID NO: 2284 - protein, 107 aa, synthetic construct
  REGION 1..107: note = Synthetic
DIQMTQSPSSLSASVGDRVTITCRTSENIYNNLAWYQQKPGKSPKLLIYAATNLADGVPSRFSGSGSGTDYTLTISSLQPEDFATYYCQHFWGTPLTFGGGTKVEIK

SEQ ID NO: 2285 - protein, 107 aa, synthetic construct
  REGION 1..107: note = Synthetic
DIQMTQSPSSLSASVGDRVTITCRTSENIYNNLAWYQQKPGKAPKLLIYAATNLADGVPSRFSGSGSGTDYTLTISSLQPEDFATYYCQHFWGTPLTFGGGTKVEIK

SEQ ID NO: 2286 - protein, 107 aa, synthetic construct
  REGION 1..107: note = Synthetic
DIQMTQSPSSLSASVGDRVTITCRTSENIYNNLAWYQQKPGKAPKLLIYAATNLAEGVPSRFSGSGSGTDYTLTISSLQPEDFATYYCQHFWGTPLTFGGGTKVEIK

SEQ ID NO: 2287 - protein, 107 aa, synthetic construct
  REGION 1..107: note = Synthetic
DIQMTQSPSSLSASVGDRVTITCRTSENIYSNLAWYQQKPGKAPKLLIYAGTNLADGVPSRFSGSGSGTDYTLTISSLQPEDFANYYCQHFWGTPLTFGGGTKVEIK

What is claimed is:

1. A complex comprising an anti-transferrin receptor (TfR) antibody covalently linked to at least one oligonucleotide, wherein the antibody comprises:
   (i) a heavy chain comprising a heavy chain variable region (VH) and a human IgG CH1 domain and lacking a human IgG CH2 domain and CH3 domain, wherein the heavy chain comprises the amino acid sequence of SEQ ID NO: 101, and
   (ii) a light chain comprising a light chain variable region (VL) and a human kappa light chain constant region, wherein the light chain comprises the amino acid sequence of SEQ ID NO: 90;
   wherein each oligonucleotide is covalently linked to a lysine residue of the anti-TfR antibody, and wherein the oligonucleotide induces dystrophin exon 51 skipping.

2. The complex of claim 1, wherein the heavy chain of the antibody comprises an N-terminal pyroglutamate.

3. The complex of claim 1, wherein the oligonucleotide is 15-35 nucleotides in length.

4. The complex of claim 1, wherein the oligonucleotide comprises a region of complementarity to a dystrophin RNA, wherein the region of complementarity is 12-35 nucleotides in length.

5. The complex of claim 1, wherein the oligonucleotide comprises a region of complementarity to the target sequence of an oligonucleotide as set forth in any one of SEQ ID NOs: 333-357, 745, and 2254, wherein the region of complementarity is 12-35 nucleotides in length.

6. The complex of claim 1, wherein the oligonucleotide comprises the nucleotide sequence of any one of SEQ ID NOs: 333-357, 745, and 2254, wherein any one or more of the thymine bases (T's) in the oligonucleotide may optionally be a uracil base (U), and wherein any one or more of the uracil bases (U's) in the oligonucleotide may optionally be a thymine base (T).

7. The complex of claim 1, wherein the oligonucleotide is a phosphorodiamidate morpholino oligomer.

8. The complex of claim 1, wherein the antibody is covalently linked to each oligonucleotide via a cleavable linker comprising a valine-citrulline sequence.

9. The complex of claim 8, wherein the complex comprises a structure of:

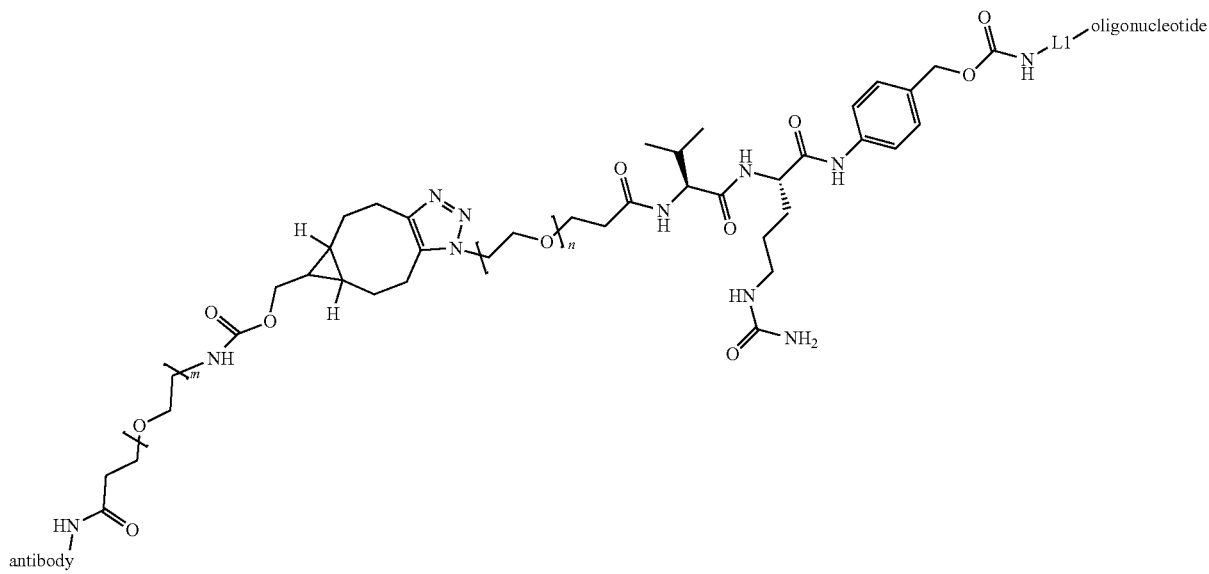

wherein n is 3 and m is 4, wherein L1 comprises a spacer that is a substituted or unsubstituted aliphatic, substituted or unsubstituted heteroaliphatic, substituted or unsubstituted carbocyclylene, substituted or unsubstituted heterocyclylene, substituted or unsubstituted arylene, substituted or unsubstituted heteroarylene, —O—, —N(R$^A$)—, —S—, —C(=O)—, —C(=O)O—, —C(=O)NR$^A$—, —NR$^A$C(=O)—, —NR$^A$C(=O) R$^A$—, —C(=O) R$^A$—, —NR$^A$C(=O)O—, —NR$^A$C(=O)N (R$^A$)—, —OC(=O)—, —OC(=O)O—, —OC(=O)N (R$^A$)—, —S(O)$_2$NR$^A$—, —NR$^A$S(O)$_2$—, or a combination thereof, wherein each R$^A$ is independently hydrogen or substituted or unsubstituted alkyl.

10. The complex of claim 9, wherein L1 comprises a structure of:

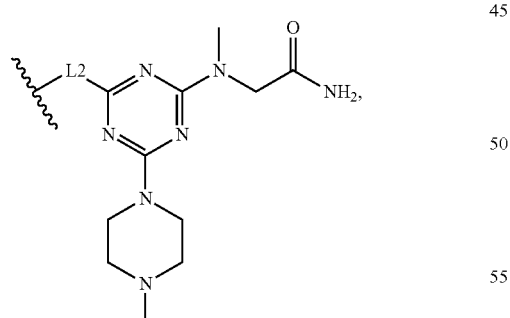

wherein the piperazine moiety links to the oligonucleotide, wherein L2 comprises

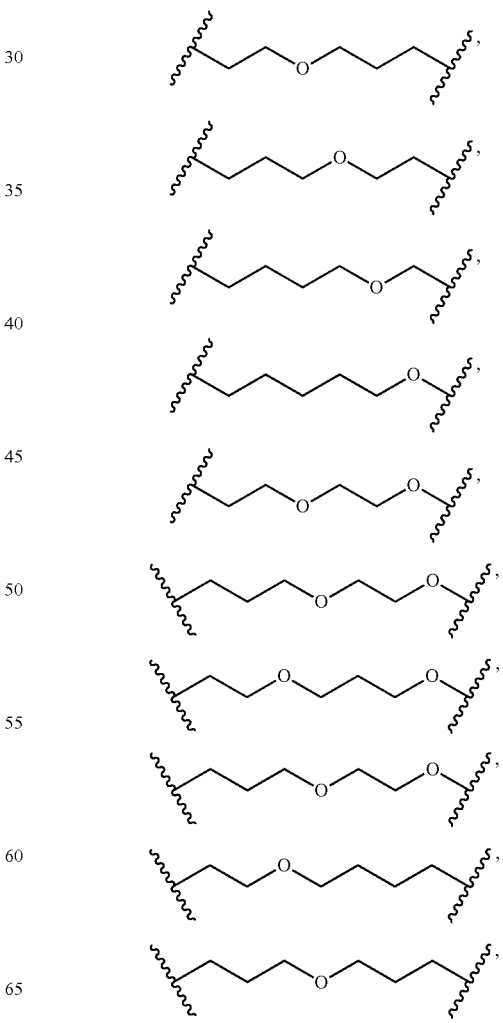

-continued

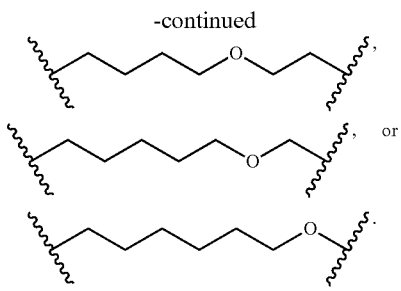

11. The complex of claim 10, wherein L2 comprises

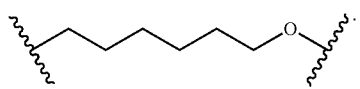

12. A method of inducing dystrophin exon 51 skipping in muscle cells of a subject, the method comprising administering to the subject a composition comprising the complex of claim 1.

13. The method of claim 12, wherein the subject is human.

14. The method of claim 12, wherein the subject has Duchenne muscular dystrophy.

15. The method of claim 12, wherein the heavy chain of the antibody comprises an N-terminal pyroglutamate.

16. A complex comprising an anti-transferrin receptor (TfR) antibody covalently linked to at least one oligonucleotide, wherein the antibody comprises:
(i) a heavy chain comprising a heavy chain variable region (VH) and a portion of a heavy chain constant region, wherein the VH comprises the amino acid sequence of SEQ ID NO: 76 and the portion of the heavy chain constant region consists of the amino acid sequence of SEQ ID NO: 96, and
(ii) a light chain comprising the amino acid sequence of SEQ ID NO: 90;
wherein each oligonucleotide is covalently linked to a lysine residue of the anti-TfR antibody, and wherein the oligonucleotide induces dystrophin exon 51 skipping.

17. The complex of claim 16, wherein the heavy chain of the antibody comprises an N-terminal pyroglutamate.

18. The complex of claim 16, wherein the portion of the heavy chain constant region consists of a CH1 domain and a portion of a hinge region.

19. The complex of claim 16, wherein the oligonucleotide is 15-35 nucleotides in length and comprises a region of complementarity to a dystrophin RNA, wherein the region of complementarity is 12-35 nucleotides in length.

20. The complex of claim 16, wherein the oligonucleotide comprises a region of complementarity to the target sequence of an oligonucleotide as set forth in any one of SEQ ID NOs: 333-357, 745, and 2254, wherein the region of complementarity is 12-35 nucleotides in length.

21. The complex of claim 16, wherein the oligonucleotide comprises the nucleotide sequence of any one of SEQ ID NOs: 333-357, 745, and 2254, wherein any one or more of the thymine bases (T's) in the oligonucleotide may optionally be a uracil base (U), and wherein any one or more of the uracil bases (U's) in the oligonucleotide may optionally be a thymine base (T).

22. The complex of claim 16, wherein the oligonucleotide is a phosphorodiamidate morpholino oligomer.

23. The complex of claim 16, wherein the antibody is covalently linked to each oligonucleotide via a cleavable linker comprising a valine-citrulline sequence.

24. The complex of claim 23, wherein the complex comprises a structure of:

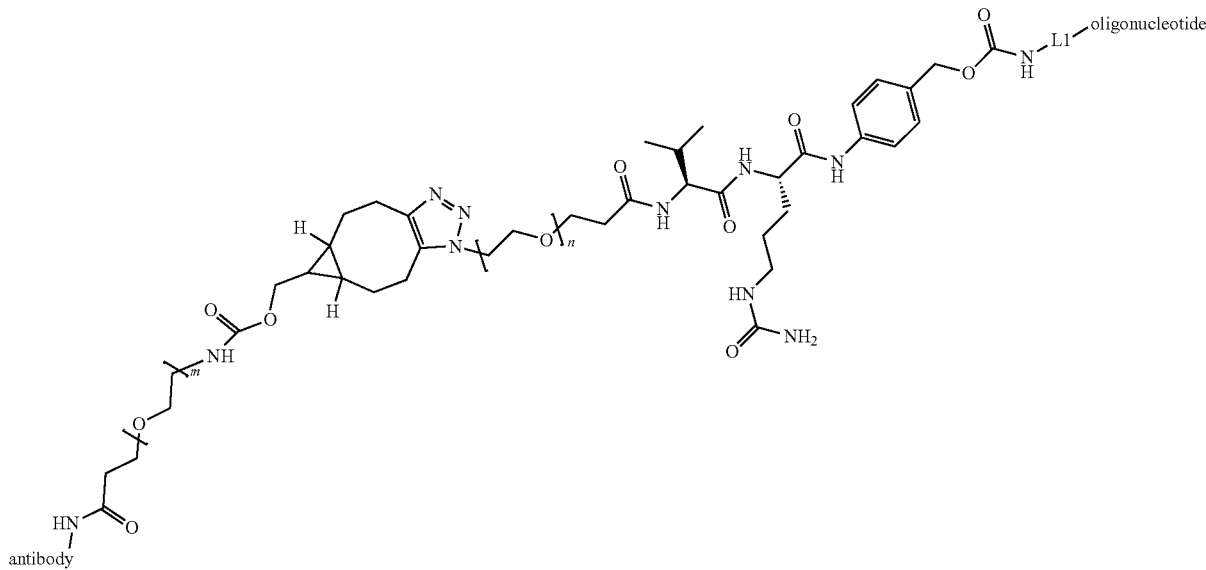

wherein n is 3 and m is 4, wherein L1 comprises a spacer that is a substituted or unsubstituted aliphatic, substituted or unsubstituted heteroaliphatic, substituted or unsubstituted carbocyclylene, substituted or unsubstituted heterocyclylene, substituted or unsubstituted arylene, substituted or unsubstituted heteroarylene, —O—, —N($R^4$)—, —S—, —C(=O)—, —C(=O)O—, —C(=O)N$R^4$—, —N$R^4$C(=O)—, —N$R^4$C(=O) $R^4$—, —C(=O) $R^4$—, —N$R^4$C(=O)O—, —N$R^4$C(=O)N ($R^4$)—, —OC(=O)—, —OC(=O)O—, —OC(=O)N ($R^4$)—, —S(O)$_2$N$R^4$, —N$R^4$S(O)$_2$—, or a combination thereof, wherein each $R^4$ is independently hydrogen or substituted or unsubstituted alkyl.

25. The complex of claim 24, wherein L1 comprises a structure of:

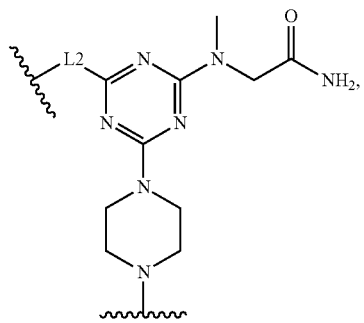

wherein the piperazine moiety links to the oligonucleotide, wherein L2 comprises

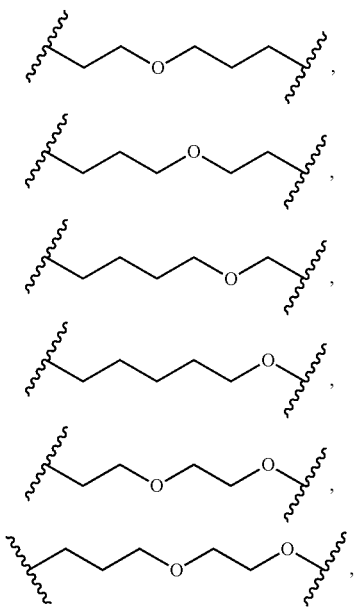

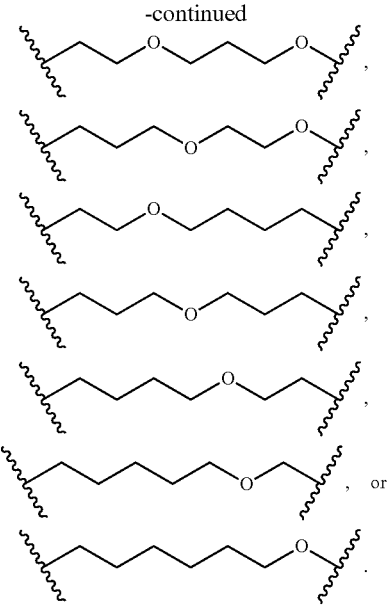

26. The complex of claim 25, wherein L2 comprises

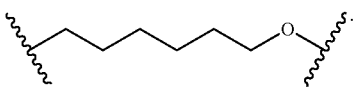 [SMILES: *CCCCCCO*]

27. A method of inducing dystrophin exon 51 skipping in muscle cells of a subject, the method comprising administering to the subject a composition comprising the complex of claim 16.

28. The method of claim 27, wherein the subject is human.

29. The method of claim 27, wherein the subject has Duchenne muscular dystrophy.

30. The method of claim 27, wherein the heavy chain of the antibody comprises an N-terminal pyroglutamate.

* * * * *